(12) United States Patent
Ledbetter et al.

(10) Patent No.: US 7,754,209 B2
(45) Date of Patent: Jul. 13, 2010

(54) BINDING CONSTRUCTS AND METHODS FOR USE THEREOF

(75) Inventors: Jeffrey A. Ledbetter, Shoreline, WA (US); Martha Susan Hayden-Ledbetter, Shoreline, WA (US)

(73) Assignee: Trubion Pharmaceuticals, Seattle, WA (US)

( * ) Notice: Subject to any disclaimer, the term of this patent is extended or adjusted under 35 U.S.C. 154(b) by 445 days.

(21) Appl. No.: 10/566,409

(22) PCT Filed: Dec. 24, 2003

(86) PCT No.: PCT/US03/41600

§ 371 (c)(1),
(2), (4) Date: Aug. 24, 2006

(87) PCT Pub. No.: WO2005/017148

PCT Pub. Date: Feb. 24, 2005

(65) Prior Publication Data

US 2007/0237779 A1    Oct. 11, 2007

Related U.S. Application Data

(63) Continuation of application No. 10/627,556, filed on Jul. 26, 2003, which is a continuation-in-part of application No. 10/053,530, filed on Jan. 17, 2002, now abandoned.

(60) Provisional application No. 60/367,358, filed on Jan. 17, 2001, now abandoned.

(51) Int. Cl.
*C07K 16/18* (2006.01)
*C07K 16/28* (2006.01)
*C07K 16/46* (2006.01)

(52) U.S. Cl. .................................. 424/133.1; 530/388.8
(58) Field of Classification Search .............. 424/133.1; 530/388.8
See application file for complete search history.

(56) References Cited

U.S. PATENT DOCUMENTS

| | | |
|---|---|---|
| 4,704,692 A | 11/1987 | Ladner |
| 4,816,567 A | 3/1989 | Cabilly et al. |
| 4,906,562 A | 3/1990 | Hellstrom et al. |
| 4,935,495 A | 6/1990 | Hellstrom et al. |
| 4,946,778 A | 8/1990 | Ladner et al. |
| 5,091,177 A | 2/1992 | Hellstrom et al. |
| 5,098,833 A | 3/1992 | Lasky et al. |
| 5,225,539 A | 7/1993 | Winter et al. |
| 5,260,203 A | 11/1993 | Ladner et al. |
| 5,434,131 A | 7/1995 | Linsley et al. |
| 5,455,030 A | 10/1995 | Ladner et al. |
| 5,500,362 A | 3/1996 | Robinson et al. |
| 5,521,288 A | 5/1996 | Linsley et al. |
| 5,530,101 A | 6/1996 | Queen et al. |
| 5,580,756 A | 12/1996 | Linsley et al. |
| 5,585,089 A | 12/1996 | Queen et al. |
| 5,597,707 A | 1/1997 | Marken et al. |
| 5,605,690 A | 2/1997 | Jacobs et al. |
| 5,637,481 A | 6/1997 | Ledbetter et al. |
| 5,645,835 A | 7/1997 | Fell, Jr. et al. |
| 5,677,425 A * | 10/1997 | Bodmer et al. ............ 530/387.1 |
| 5,693,762 A | 12/1997 | Queen et al. |
| 5,709,859 A | 1/1998 | Aruffo et al. |
| 5,714,147 A | 2/1998 | Capon et al. |
| 5,736,137 A | 4/1998 | Anderson et al. |
| 5,770,197 A | 6/1998 | Linsley et al. |
| 5,773,253 A | 6/1998 | Linsley et al. |
| 5,776,456 A | 7/1998 | Anderson et al. |
| 5,795,572 A | 8/1998 | Diegel et al. |
| 5,807,734 A | 9/1998 | Diegel et al. |
| 5,844,093 A | 12/1998 | Kettleborough et al. |
| 5,844,095 A | 12/1998 | Linsley et al. |
| 5,869,049 A | 2/1999 | Noelle et al. |
| 5,869,620 A | 2/1999 | Whitlow et al. |
| 5,876,718 A | 3/1999 | Noelle et al. |
| 5,876,950 A | 3/1999 | Siadak et al. |
| 5,888,773 A | 3/1999 | Jost et al. |
| 5,892,019 A | 4/1999 | Schlom et al. |

(Continued)

FOREIGN PATENT DOCUMENTS

EP    0274394 A2    7/1988

(Continued)

OTHER PUBLICATIONS

Hayden et al. (Therapeutic Immunol. 94:3-15 (1994).*

(Continued)

*Primary Examiner*—Lynn Bristol
(74) *Attorney, Agent, or Firm*—Seed IP Law Group PLLC

(57) ABSTRACT

The invention relates to novel binding domain-immunoglobulin fusion proteins that feature a binding domain for a cognate structure such as an antigen, a counterreceptor or the like, a wild-type IgG, IGA or IgE hinge-acting region, i.e., IgE CH2, region polypeptide or a mutant IgGI hinge region polypeptide having either zero, one or two cysteine residues, and immunoglobulin CH2 and CH3 domains, and that are capable of ADCC and/or CDC while occurring predominantly as polypeptides that are compromised in their ability to form disulfide-linked multimers. The fusion proteins can be recombinantly produced at high expression levels. Also provided are related compositions and methods, including cell surface forms of the fusion proteins and immunotherapeutic applications of the fusion proteins and of polynucleotides encoding such fusion proteins.

6 Claims, 88 Drawing Sheets

U.S. PATENT DOCUMENTS

| | | | |
|---|---|---|---|
| 5,916,560 | A | 6/1999 | Larsen et al. |
| 6,015,695 | A | 1/2000 | Casterman et al. |
| 6,074,644 | A * | 6/2000 | Pastan et al. ............. 424/178.1 |
| 6,087,329 | A | 7/2000 | Armitage et al. |
| 6,090,914 | A | 7/2000 | Linsley et al. |
| 6,147,203 | A * | 11/2000 | Pastan et al. ............. 536/23.53 |
| 6,150,584 | A | 11/2000 | Kucherlapati et al. |
| 6,194,551 | B1 | 2/2001 | Idusogie et al. |
| 6,264,951 | B1 | 7/2001 | Armitage et al. |
| 6,284,536 | B1 | 9/2001 | Morrison et al. |
| 6,312,692 | B1 | 11/2001 | Noelle et al. |
| 6,376,459 | B1 | 4/2002 | Aruffo et al. |
| 6,384,198 | B1 | 5/2002 | Diegel et al. |
| 6,410,319 | B1 | 6/2002 | Raubitschek et al. |
| 6,444,792 | B1 | 9/2002 | Gray et al. |
| 6,472,510 | B1 | 10/2002 | Aruffo et al. |
| 6,482,919 | B2 * | 11/2002 | Ledbetter et al. ............. 530/324 |
| 6,623,940 | B1 * | 9/2003 | Ledbetter et al. ........... 435/69.1 |
| 6,641,809 | B1 | 11/2003 | Linsley et al. |
| 6,815,540 | B1 | 11/2004 | Pluckthun et al. |
| 7,074,403 | B1 | 7/2006 | Goldenberg et al. |
| 2001/0004135 | A1 | 6/2001 | Okamura |
| 2002/0031510 | A1 | 3/2002 | Larsen et al. |
| 2002/0039557 | A1 | 4/2002 | White |
| 2002/0155604 | A1 | 10/2002 | Ledbetter et al. |
| 2003/0044423 | A1 | 3/2003 | Gillies et al. |
| 2003/0088074 | A1 | 5/2003 | Hamers et al. |
| 2003/0118592 | A1 | 6/2003 | Ledbetter et al. ......... 424/178.1 |
| 2003/0133930 | A1 | 7/2003 | Goldenberg et al. |
| 2003/0219433 | A1 | 11/2003 | Hansen et al. |
| 2003/0219436 | A1 | 11/2003 | Ledbetter et al. |
| 2003/0219446 | A1 | 11/2003 | Linsley et al. |
| 2003/0219876 | A1 | 11/2003 | Ledbetter et al. |
| 2004/0058445 | A1 | 3/2004 | Ledbetter et al. |
| 2005/0084933 | A1 * | 4/2005 | Schilling et al. ........... 435/69.1 |

FOREIGN PATENT DOCUMENTS

| | | |
|---|---|---|
| EP | 0555880 | 8/1993 |
| EP | 0586002 | 3/1994 |
| EP | 0682039 | 11/1995 |
| EP | 0757099 | 2/1997 |
| EP | 1186300 | 3/2002 |
| WO | WO 88/04936 | 7/1988 |
| WO | WO-89/07142 | 8/1989 |
| WO | WO-92/00092 | 1/1992 |
| WO | WO-92/21755 | 12/1992 |
| WO | WO-93/00431 | 1/1993 |
| WO | WO-94/04678 | 3/1994 |
| WO | WO-94/05690 | 3/1994 |
| WO | WO-94/25591 | 11/1994 |
| WO | WO-95/09917 | 4/1995 |
| WO | WO-96/34103 | 10/1996 |
| WO | WO 98/02462 | 1/1998 |
| WO | WO-99/42077 | 8/1999 |
| WO | WO-00/44777 | 8/2000 |
| WO | WO 02/056910 A1 | 7/2002 |

OTHER PUBLICATIONS

MacCallum et al. (J. Mol. Biol. (1996) 262:732-745).*
De Pascalis et al. The Journal of Immunology (2002) 169, 3076-3084.*
Casset et al. (2003) BBRC 307, 198-205.*
Vajdos et al. (2002) J. Mol. Biol. 320, 415-428.*
Holm et al (2007) Mol. Immunol. 44: 1075-1084.*
Chen et al. J. Mol. Bio. (1999) 293, 865-881.*
Wu et al. J. Mol. Biol. (1999) 294, 151-162.*
Brummell et al. (Biochemistry 32:1180-1187 (1993)).*
Kobayashi et al. (Protein Engineering 12:879-844 (1999)).*
Burks et al. (PNAS 94:412-417 (1997)).*
Jang et al. (Molec. Immunol. 35:1207-1217 (1998)).*
Brorson et al. (J. Immunol. 163:6694-6701 (1999)).*
Coleman (Research in Immunol. 145:33-36 (1994)).*
Smith-Gill et al. (J. Immunol. 139:4135-4144 (1987)).*
Kumar et al. (J. Biol. Chem. 275:35129-35136 (2000)).*
Song et al. (Biochem Biophys Res Comm 268:390-394 (2000)).*
Dorrington et al. (Arch. Immunol. Ther. Exp. 29(3): 275-282 (1981); Abstract only).*
Dufner (Trends Biotechnol. 24(11):523-29 (2006)).*
Aicher et al., Characterization of human inducible costimulator ligand expression and function, J. Immunol., 164:4689-4696, 2000.
Anderson et al., Targeted anti-cancer therapy using rituximab, a chimeric anti-CD-20 antibody (IDEC-c2B8) in the treatment of non-Hodgkin's B-cell lymphoma, Biochemical Society Transactions Colchester, Essex, Great Britain, pp. 705-708, 1997.
Batra et al., Single-chain immunotoxins at the human transferrin receptor containing *Pseudomonas* exotoxin A or diphtheria toxin: anti-TFR(Fv)-PE40 and DT388-anti-TFR(Fv), Mol. Cell. Biol., 11:2200-2205, 1991.
Beiske et al., Triggering of neoplastic B cells via surface IgM and the cell surface antigens CD20 and CD40: responses differ from normal blood B cells and are restricted to certain morphologic subsets, Int. J. Cancer, 42:521-528, 1988.
Brekke et al., The structural requirements for complement activation by IgG: does it hinge on the hinge?, Immunol. Today, 16:85-90, 1995.
Brown et al., Treatment of B-cell lymphomas with anti-idiotype antibodies alone and in combination with alpha interferon, Blood, 73:651-661, 1989.
Burgess et al., Possible dissociation of the heparin-binding and mitogenic activities of heparin-binding (acidic fibroblast) growth factor-1 from its receptor-binding activities by site-directed mutagenesis of a single lysine residue, J. Cell Biol., 111:2129-2138, 1990.
Burke et al., Radioimmunotherapy for acute leukemia, Cancer Control, 9:106-113, 2002.
Campbell et al., Biology, $5^{th}$ edition, p. 856, 1999.
Carter, Improving the efficacy of antibody-based cancer therapies, Nature, 1:118-129, 2001.
Chaudhary et al., A recombinant immunotoxin consisting of two antibody variable domains, fused to *Pseudomonas* exotoxin, Nature, 339:394-397, 1989.
Clark et al., Activation of human B cells mediated through two distinct surface differentiation antigens, Bp35 and Bp50, PNAS USA, 83:4494-4498, 1986.
Clark et al., Structure, function, and genetics of human B cell-associated surface molecules, Adv. Cancer Res., 52:81-149, 1989.
Coloma, et al., The hinge as a spacer contributes to covalent assembly and is required for function of IgG, J. Immunol., 158:733-740, 1997.
Cruse et al., Illustrated Dictionary of Immunology, CRC Press, p. 157, 1995.
Damle et al., Direct helper T cell-induced B cell differentiation involves interaction between T cell antigen CD28 and B cell activation antigen B7, Eur. J. Immunol., 21:1277-1282, 1991.
Davies et al., 'Camelising' human antibody fragments: NMR studies on VH domains, FEBS Letters, 339:285-290, 1994.
Davis et al., High level expression in Chinese hamster ovary cells of soluble forms of CD4 T lymphocyte glycoprotein including glycosylation variants, J. Biol. Chem., 265:10410-10418, 1990.
Desmyter et al., Crystal structure of a camel single-domain VH antibody fragment in complex with lysozyme, Nat. Struct. Biol., 3:803-811, 1996.
Dietsch et al., Bispecific globulins, novel tools for the study of receptor cellular interactions, J. Immunol. Met., 162:123-132, 1993.
Dietsch et al., Coengagement of CD2 with LEA-1 or VLA-4 by bispecific ligand fusion proteins primes T cells to respond more effectively to T cell receptor-dependent signals, J. Leukocyte Biol., 56:444-452, 1994.
Dillman et al., Continuous infusion of T101 monoclonal antibody in chronic lymphocytic leukemia and cutaneous T-cell lymphoma, J. Biol. Response Modifiers, 5:394-410, 1986.
Dorai et al., Role of inter-heavy and light chain disulfide bonds in the effector functions of human immunoglobulin IgG1, Mol. Immunol., 29:1487-1491, 1992.

Duncan et al., The binding site for C1q on IgG, Nature, 322:738-740, 1988.

Durie et al., Prevention of collagen-induced arthritis with an antibody to gp39 the ligand for CD40, Science, 261:1328-1330, 1993.

Einfeld et al., Molecular cloning of the human B cell CD20 receptor predicts a hydrophobic protein with multiple transmembrane domains, EMBO J., 7:711-717, 1988.

Fell et al., Genetic construction and characterization of a fusion protein consisting of a chimeric F(ab') with specificity for carcinomas and human IL-2, J. Immunol., 146:2446-2452, 1991.

Filpula et al., Single-chain Fv designs for protein, cell and gene therapeutics, Exp. Opin. Ther. Patents, 9:231-245, 1999.

Funakoshi et al., Inhibition of human B-cell lymphoma growth by CD40 stimulation, Blood, 83:2787-2794, 1994.

Funakoshi et at., Differential in vitro and in vivo antitumor effects mediated by anti-CD40 and anti-CD20 monoclonal antibodies against human B-cell lymphomas, J. Immunother., 19:93-101, 1996.

Genbank Accession No. L07414, *Homo sapiens* CD40 surface protein mRNA, complete cds, Apr. 27, 1993.

Genbank Accession No. M62541, Mouse CD20 cell surface protein mRNA, complete cds, Jul. 26, 1993.

Genbank Accession No. M62542, Mouse CD19 gene, complete cds, Apr. 27, 1993.

Genbank Accession No. M83312, Mouse CD40 mRNA, complete cds, Sep. 23, 1996.

Genbank Accession No. M84371, Human CD19 gene, complete cds, Jul. 17, 1995.

Genbank Accession No. X14046, Human mRNA for leukocyte antigen CD37, Sep. 12, 1993.

Genbank Accession No. X53517, *R.norvegicus* mRNA for antigen CD37, Feb. 17, 1992.

Genbank Accession No. X65453, *M.musculus* mRNA for CD40 ligand, Apr. 26, 2001.

Genbank Accession No. X67878, *H.sapiens* mRNA for CD40 ligand, Jun. 6, 1997.

Genbank Accession No. X96710, *H.sapiens* mRNA for CD40-ligand, Feb. 13, 1997.

Genbank Accession No. Y10507, *H.sapiens* mRNA for CD40 protein, Sep. 4, 1997.

Gillies et al., Antigen binding and biological activities of engineered mutant chimeric antibodies with human tumor specificities, Hum. Antibodies Hybridomas, 1:47-54, 1990.

Gilliland et al., Rapid and reliable cloning of antibody variable regions and generation of recombinant single chain antibody fragments, Tissue Antigens, 47:1-20, 1996.

Hamers-Casterman et al., Naturally occurring antibodies devoid of light chains, Nature, 363:446-448, 1993.

Hayden et al., Antibody engineering, Curr. Opin. Immunol., 9:201-212, 1997.

Hayden et al., Costimulation by CD28 sFv expressed on the tumor cell surface or as a soluble bispecific molecule targeted to the L6 carcinoma antigen, Tissue Antigens, 48:242-254, 1996.

Hayden et al., Single-chain mono- and bispecific antibody derivatives with novel biological properties and antitumour activity from a COS cell transient expression system, Ther. Immunol., 1:3-15, 1994.

Hekman et al., Initial experience with treatment of human B cell lymphoma with anti-CD19 monoclonal antibody, Cancer Immunol. Immunother., 32:364-372, 1991.

Hollenbaugh et al., The human T cell antigen gp39, a member of the TNF gene family, is ligand for the CD40 receptor: expression of a soluble form of gp39 with B cell co-stimulatory activity, EMBO J., 11:4313-4321, 1992.

Holliger et al., Engineered antibody fragments and the rise of single domains, Nat. Biotechnol., 23:1126-1136, 2005.

Hu et al., Minibody: a novel engineered anti-carcinoembryonic antigen antibody fragment (single-chain Fv-CH3) which exhibits rapid, high-level targeting of xenografts, Cancer Res., 56:3055-3061 (abstract), 1996.

Hudson, Recombinant antibodies: a novel approach to cancer diagnosis and therapy, Exp. Opin. Invest. Drugs, 9:1231-1242, 2000.

Hudson, Recombinant antibody fragments, Curr. Opin. Biotechnol., 9:395-402, 1998.

Huston et al., Protein engineering of antibody binding sites: recovery of specific activity in an anti-digoxigenin single-chain Fv analogue produced in *Escherichia coli*, PNAS USA, 85:5879-5883, 1988.

Isenman, et al., Correlation between the exposure of aromatic chromophores, Biochemistry, 16:233-240, 1977.

Jost et al., Mammalian expression and secretion of functional single chain Fv molecules, J. Biol. Chem., 269:26267-26273, 1994.

Kaminski et al., Radioimmunotherapy of B-cell lymphoma with [131I] anti-B1 (anti-CD20) antibody, N. Eng. J. Med., 329:459-465, 1993.

Kato et al., A conformational change in the Fc precludes the binding of two Fcγ receptor molecules to one IgG, Immunol. Today, 21:310-312, 2000.

Klein et al., Expression of biological effector functions by immunoglobulin G molecules lacking the hinge region, PNAS USA, 78:524-528, 1981.

Koolwijk et al., Interaction between hybrid mouse monoclonal antibodies and the human high-affinity IgG FcR, huFcTRI, on U937, J. Immunol., 143:1656-1662, 1989.

Kortt, et al., Dimeric and trimeric antibodies: high avidity scFvs for cancer targeting, Biomol. Eng., 18:95-108, 2001.

Las Veld et al., Treatment of low-grade non-Hodgkin's lymphoma with continuous infusion of low-dose recombinant interleukin-2 in combination with the B-cell-specific monoclonal antibody CLB-CD19, Cancer Immunol. Immunother., 40:37-47, 1995.

Lazar et al., Transforming growth factor alpha: mutation of aspartic acid 47 and leucine 48 results in different biological activities, Mol. Cell. Biol., 8:1247-1252, 1988.

Ledbetter et al., Augmentation of normal and malignant B cell proliferation by monoclonal antibody to the B cell-specific antigen BP50 (CDW40), J. Immunol., 138:788-794, 1987.

Lee et at., Generation and characterization of a novel single-gene-encoded single-chain immunoglobulin molecule with antigen binding activity and effector functions, Mol. Immunol., 36:61-71, 1999.

Li et al., Single-chain antibodies against human insulin-like growth factor I receptor: expression, purification and effect on tumor growth, Cancer Immunol. Immunother., 49:243-252, 2000.

Lin et al., Structure-function relationships in glucagon: properties of highly purified des-His-1-, monoiodo-, and (des-Asn-28, Thr-29)(homoserine lactone-27)-glucagon, Biochemistry, 14:1559-1563, 1975.

Liu et at., Production of a mouse-human chimeric monoclonal antibody to CD20 with potent Fc-dependent biologic activity, J. Immunol., 139:3521-3526, 1987.

Maloney et al., IDEC-C2B8 (Rituximab) anti-CD20 monoclonal antibody therapy in patients with relapsed low-grade non-Hodgkin's lymphoma, Blood, 90:2188-2195, 1997.

Maloney et al., IDEC-C2B8: results of a phase I multiple-dose trial in patients with relapsed non-Hodgkin's lymphoma, J. Clin. Oncol., 15:3266-3274, 1997.

Martin et al., Efficient neutralization and disruption of rhinovirus by chimeric ICAM-1 / immunoglobulin molecules, J. Virol., 67:3561-3568, 1993.

McLaughlin et al., IDEC-C2B8 anti-CD20 antibody: final report on a phase III pivotal trial in patients (PTS) with relapsed low-grade or follicular lymphoma (LG/F NHL), Blood, 88:90a (abstract 349), 1996.

Michaelsen et al., Antibody dependent cell-mediated cytotoxicity induced by chimeric mouse-human IgG subclasses and IgG3 antibodies with altered hinge region, Mol. Immunol., 29:319-326, 1992.

Michaelsen et al., Enhancement of complement activation and cytolysis of human IgG3 by deletion of hinge exons, Scand. J. Immunol., 32:517-528, 1990.

Michaelsen et al., One disulfide bond in front of the second heavy chain constant region is necessary and sufficient for effector functions of human IgG3 without a genetic hinge, PNAS USA 91:9243-9247, 1994.

Multani et al., Monoclonal antibody-based therapies for hematologic malignancies, J. Clin. Oncol., 16:3691-3710, 1998.

Muñoz et al., The C(H)1 domain of IgG is not essential for C3 covalent binding: importance of the other constant domains as targets for C3, Int. Immunol., 10:97-106, 1998.

Muyldermans, Single domain camel antibodies: current status, J. Biotechnol., 74:277-302 (abstract), 2001.

Nikula et al., Impact of the high tyrosine fraction in complementarity determining regions: measured and predicted effects of radioiodination on IgG immunoreactivity, Mol. Immunol. 32:865-872, 1995.

Nuttall et al., Immunoglobulin VH domains and beyond: design and selection of single-domain binding and targeting reagent, Curr. Pharm. Biotechnol., 1:253-263, 2000.

Park et al., Generation and characterization of a novel tetravalent bispecific antibody that binds to hepatitis B virus surface antigens, Mol. Immunol., 37:1123-1130, 2000.

Paul, Fudamental Immunology, Raven Press, chapter 8, p. 242, 1993.

Pawson et al., Treatment of T-cell prolymphocytic leukemia with human CD52 antibody, J. Clin. Oncol., 15:2667-2672, 1997.

Press et al., Radiolabeled-antibody therapy of B-cell lymphoma with autologous bone marrow support. N. Eng. J. Med., 329:1219-1224, 1993.

Press et al., Monoclonal antibody 1F5 (anti-CD20) serotherapy of human B cell lymphomas, Blood, 69:584-591, 1987.

Print-out of PubMed search for des-leucine (p. 1).

Radaev et al., Recognition of IgG by Fcγ receptor: the role of Fc glycosylation and the binding of peptide inhibitors, J. Biol. Chem., 276:16478-16483, 2001.

Radaev et al., The structure of a human type III Fcγ receptor in complex with Fc, J. Biol. Chem., 276:16469-16477, 2001.

Redpath et al., The influence of the hinge region length in binding of human IgG to human Fcγ receptors, Hum. Immunol., 59:720-727, 1998.

Roux et al., Comparisons of the ability of human IgG3 hinge mutants, IgM, IgE, and IgA2, to form small immune complexes: a role for flexibility and geometry, J. Immunol., 161:4083-4090, 1998.

Rudikoff et al., Single amino acid substitution altering antigen-binding specificity, PNAS USA, 79:1979-1983, 1982.

Scheinberg et al., A phase I toxicity, pharmacology, and dosimetry trial of monoclonal antibody OKB7 in patients with non-Hodgkin's lymphoma: effects of tumor burden and antigen expression, J. Clin. Oncol., 85:792-803, 1990.

Schwartz et al., A superactive insulin: [B10-aspartic acid]insulin(human), PNAS USA, 84:6408-6411, 1987.

Search output from ATCC website for hybridomas: 2H7 (pp. 1-2), 1D8 (p. 1), HD37 (p. 1), G28-1 (p. 1), 4.4.220 (p. 1), Fc2-2 (p. 1), UCHL-1 (p. 1), 5B9 (p. 1), L6 (p. 1), 10A8 (p. 1), 2e12 (p. 1), 40.2.36 (p. 1) and G19-4 (p. 1).

Segal et al., Introduction: bispecific antibodies, J. Immunol. Met., 248:1-6, 2001.

Sensel et al., Engineering novel antibody molecules, Chem. Immunol., 65:129-158, 1997.

Shan et al., Apoptosis of malignant human B cells by ligation of CD20 with monoclonal antibodies, Blood, 91:1644-1652, 1998.

Shan et al., Characterization of scFv-Ig constructs generated from the anti-CD20 mAb 1F5 using linker peptides of varying lengths, J. Immunol., 162:6589-6595, 1999.

Shin et al., Genetically-engineered antibodies: tools for the study of diverse properties of the antibody molecule, Immunol. Rev., 130:87-107, 1992.

Shin et al., Hybrid antibodies, Intern. Rev. Immunol., 10:177-186, 1993.

Shu et al., Secretion of a single-gene-encoded immunoglobulin from myeloma cells, PNAS USA, 90:7995-7999, 1993.

Smellie et al., Radioimmunotherapy of breast cancer xenografts with monoclonal antibody ICR12 against c-erbB2 p. 185: comparison of iodogen and N-succinimidyl 4-methyl-3-(tri-n-butylstannyl)benzoate radioiodination methods, Cancer Res. 55:5842S-5846S, 1995.

Sondermann et al., The 3.2-A crystal structure of the human IgG1 Fc fragment-FcγRIII complex, Nature, 406:267-273, 2000.

Souriau et al., Recombinant antibodies for cancer diagnosis and therapy, Exp. Opin. Biol. Ther., 3:305-318, 2003.

Sporici et al., ICOS ligand costimulation is required for T-cell encephalitogenicity, Clin. Immunol., 100:277-288, 2001.

Stevenson et al., Mechanisms in removal of tumor by antibody, Cell Biophys., 24:45-50, 1994.

Tan, et al, Influence of the hinge region on complement activation, C1q binding, and segmental flexibility in chimeric human immunoglobulins, PNAS USA, 87:162-166, 1990.

Tao, et al., Role of carbohydrate in the structure and effector functions mediated by the human IgG constant region, J. Immunol., 143:2595-2601, 1989.

Thommesen et al., Lysine 322 in the human IgG3 CH2 domain is crucial for antibody dependent complement activation, Mol. Immunol., 37:995-1004, 2000.

Traunecker et al., Bispecific single chain molecules (Janusins) target cytotoxic lymphocyte on HIV infected cells, EMBO J., 10:3655-3659, 1991.

Van Den Abbeele, et al., Antigen-binding site protection during radiolabeling leads to a higher immunoreactive fraction, J. Nucl. Med., 32:116-122, 1991.

Walker et al., Aglycosylation of human IgG1 and IgG3 monoclonal antibodies can eliminate recognition by human cells expressing Fcγ RI and/or Fcγ RII receptors, 1989, Biochem. J., 259:347-353, 1989.

Ward et al., Binding activities of a repertoire of single immunoglobulin variable domains secreted from *Escherichia coli*, Nature, 341:544-546 (abstract), 1989.

White et al., Activation of dense human tonsilar B cells: induction of c-myc gene expression via two distinct signal transduction pathways, J. Immunol., 146:846-53, 1991.

Wörn et al., Stability engineering of antibody single-chain Fv fragments, J. Mol. Biol., 305:989-1010, 2001.

Wu, et al., Multimerization of a chimeric anti-CD20 single-chain Fv-Fc fusion protein is mediated through variable domain exchange, Protein Eng., 14:1025-1033, 2001.

Ye et al., Gene therapy for cancer using single-chain Fv fragments specific for 4-1BB, Nat. Med., 8:343-348, 2002.

Yokota et al Rapid tumor penetration of a single-chain Fv and comparison with other immunoglobulin forms, Cancer Res., 52:3402-3408, 1992.

Zhorov, et al., Oxidative iodination of rabbit IgG: localization of the label in the Fc fragment and modification effects, Biokhimiia, 56:828-838, 1991.

Wang, Baiyang et al., "Human single-chain Fv immunoconjugates targeted to a melanoma-associated chondroitin sulfate proteoglycan mediate specific lysis of human melanoma cells by natural killer cells and complement," *Proc. Natl. Acad. Sci. USA* 96:1627-1632, Feb. 1999.

Clark, Edward A. et al., "Role of the Bp35 cell surface polypeptide in human B-cell activation," *Proc. Natl. Acad. Sci. USA* 82:1766-1770, Mar. 1985.

Welschof, Martin et al., "The Antigen Binding Domain of Non-idiotypic Human Anti-F(ab')$^2$ Autoantibodies: Study of their Interaction with IgG Hinge Region Epitopes," *Human Immunology* 60:282-290, 1999.

* cited by examiner

2H7scFv-Ig cDNA and predicted amino acid sequence:

```
      HindIII        |2H7 V_L Leader Peptide→
      ~~~~~~~
                     M   D   F   Q   V   Q   I   F   S   F   L   L   I   S   A   S
  1   AAGCTTGCCG CCATGGATTT TCAAGTGCAG ATTTTCAGCT TCCTGCTAAT CAGTGCTTCA

|2H7 V_L →
      V   I   I   A   R   G   Q   I   V   L   S   Q   S   P   A   I   L   S   A   S
 61   GTCATAATTG CCAGAGGACA AATTGTTCTC TCCCAGTCTC CAGCAATCCT GTCTGCATCT

P   G   E   K   V   T   M   T   C   R   A   S   S   S   V   S   Y   M   H   W
121   CCAGGGGAGA AGGTCACAAT GACTTGCAGG GCCAGCTCAA GTGTAAGTTA CATGCACTGG

BamHI
                      ~~~~~~~
      Y   Q   Q   K   P   G   S   S   P   K   P   W   I   Y   A   P   S   N   L   A
181   TACCAGCAGA AGCCAGGATC CTCCCCCAAA CCCTGGATTT ATGCCCCATC CAACCTGGCT

S   G   V   P   A   R   F   S   G   S   G   S   G   T   S   Y   S   L   T   I
241   TCTGGAGTCC CTGCTCGCTT CAGTGGCAGT GGGTCTGGGA CCTCTTACTC TCTCACAATC

S   R   V   E   A   E   D   A   A   T   Y   Y   C   Q   Q   W   S   F   N   P
301   AGCAGAGTGG AGGCTGAAGA TGCTGCCACT TATTACTGCC AGCAGTGGAG TTTTAACCCA

|(Gly_4Ser)_3 Linker
      P   T   F   G   A   G   T   K   L   E   L   K   G   G   G   S   G   G   G
361   CCCACGTTCG GTGCTGGGAC CAAGCTGGAG CTGAAAGGTG GCGGTGGCTC GGGCGGTGGT

|2H7 V_H →
      G   S   G   G   G   S   Q   A   Y   L   Q   Q   S   G   A   E   L   V
421   GGATCTGGAG GAGGTGGGAG CTCTCAGGCT TATCTACAGC AGTCTGGGGC TGAGCTGGTG

R   P   G   A   S   V   K   M   S   C   K   A   S   G   Y   T   F   T   S   Y
481   AGGCCTGGGG CCTCAGTGAA GATGTCCTGC AAGGCTTCTG GCTACACATT TACCAGTTAC

N   M   H   W   V   K   Q   T   P   R   Q   G   L   E   W   I   G   A   I   Y
541   AATATGCACT GGGTAAAGCA GACACCTAGA CAGGGCCTGG AATGGATTGG AGCTATTTAT

P   G   N   G   D   T   S   Y   N   Q   K   F   K   G   K   A   T   L   T   V
601   CCAGGAAATG GTGATACTTC CTACAATCAG AAGTTCAAGG GCAAGGCCAC ACTGACTGTA

D   K   S   S   S   T   A   Y   M   Q   L   S   S   L   T   S   E   D   S   A
661   GACAAATCCT CCAGCACAGC CTACATGCAG CTCAGCAGCC TGACATCTGA AGACTCTGCG

V   Y   F   C   A   R   V   V   Y   Y   S   N   S   Y   W   Y   F   D   V   W
721   GTCTATTTCT GTGCAAGAGT GGTGTACTAT AGTAACTCTT ACTGGTACTT CGATGTCTGG
```

Fig. 1

```
                                            BclI
                                          ~~~~~~~~  |human IgG1 Fc domain →
             G  T  G  T    T  V  T    V  S  D  Q    E  P  K  S    C  D  K  T  H
       781   GGCACAGGGA   CCACGGTCAC   CGTCTCTGAT   CAGGAGCCCA   AATCTTGTGA CAAAACTCAC T  C  P  P    C  P  A    P  E  L  L    G  G  P  S    V  F  L  P  P
       841   ACATGCCCAC   CGTGCCCAGC   ACCTGAACTC   CTGGGGGGAC   CGTCAGTCTT CCTCTTCCCC P  K  P  K    D  T  L    M  I  S  R    T  P  E  V    T  C  V  V  V
       901   CCAAAACCCA   AGGACACCCT   CATGATCTCC   CGGACCCCTG   AGGTCACATG CGTGGTGGTG D  V  S  H    E  D  P    E  V  K  F    N  W  Y  V    D  G  V  E  V
       961   GACGTGAGCC   ACGAAGACCC   TGAGGTCAAG   TTCAACTGGT   ACGTGGACGG CGTGGAGGTG H  N  A  K    T  K  P    R  E  E  Q    Y  N  S  T    Y  R  V  V  S
      1021   CATAATGCCA   AGACAAAGCC   GCGGGAGGAG   CAGTACAACA   GCACGTACCG TGTGGTCAGC V  L  T  V    L  H  Q    D  W  L  N    G  K  E  Y    K  C  K  V  S
      1081   GTCCTCACCG   TCCTGCACCA   GGACTGGCTG   AATGGCAAGG   AGTACAAGTG CAAGGTCTCC N  K  A  L    P  A  P    I  E  K  T    I  S  K  A    K  G  Q  P  R
      1141   AACAAAGCCC   TCCAGCCCC   CATCGAGAAA   ACAATCTCCA   AAGCCAAAGG GCAGCCCCGA E  P  Q  V    Y  T  L    P  P  S  R    D  E  L  T    K  N  Q  V  S
      1201   GAACCACAGG   TGTACACCCT   GCCCCCATCC   CGGGATGAGC   TGACCAAGAA CCAGGTCAGC L  T  C  L    V  K  G    F  Y  P  S    D  I  A  V    E  W  E  S  N
      1261   CTGACCTGCC   TGGTCAAAGG   CTTCTATCCC   AGCGACATCG   CCGTGGAGTG GGAGAGCAAT G  Q  P  E    N  N  Y    K  T  T  P    P  V  L  D    S  D  G  S  F
      1321   GGGCAGCCGG   AGAACAACTA   CAAGACCACG   CCTCCCGTGC   TGGACTCCGA CGGCTCCTTC F  L  Y  S    K  L  T    V  D  K  S    R  W  Q  Q    G  N  V  F  S
      1381   TTCCTCTACA   GCAAGCTCAC   CGTGGACAAG   AGCAGGTGGC   AGCAGGGGAA CGTCTTCTCA C  S  V  M    H  E  A    L  H  N  H    Y  T  Q  K    S  L  S  L  S
      1441   TGCTCCGTGA   TGCATGAGGC   TCTGCACAAC   CACTACACGC   AGAAGAGCCT CTCCCTGTCT XbaI
                                        ~~~~~
             P  G  K  *
      1501   CCGGGTAAAT GATCTAGA
```

*Fig. 1 (continued)*

Complement Mediated B Cell Killing After Binding of
CD20-targeted 2H7 scFvIGG1 (SSS-S) H WCKH2 WCKH3:

| 2H7scFv-Ig Concentration | RAMOS # live cells/total cells | | BJAB # live cells/total cells | |
|---|---|---|---|---|
| 20 µg/ml + complement | - | 0.16 | - | 0.07 |
| 5 µg/ml + complement | - | 0.2 | - | N.D. |
| 1.25 µg/ml + complement | - | 0.32 | - | 0.1 |
| Complement alone | - | 0.98 | - | 0.94 |

*Viability was determined by trypan blue exclusion and is tabulated as the fraction of viable cells out of the total number of cells counted.
**N.D. (not determined).

*Fig. 4A*

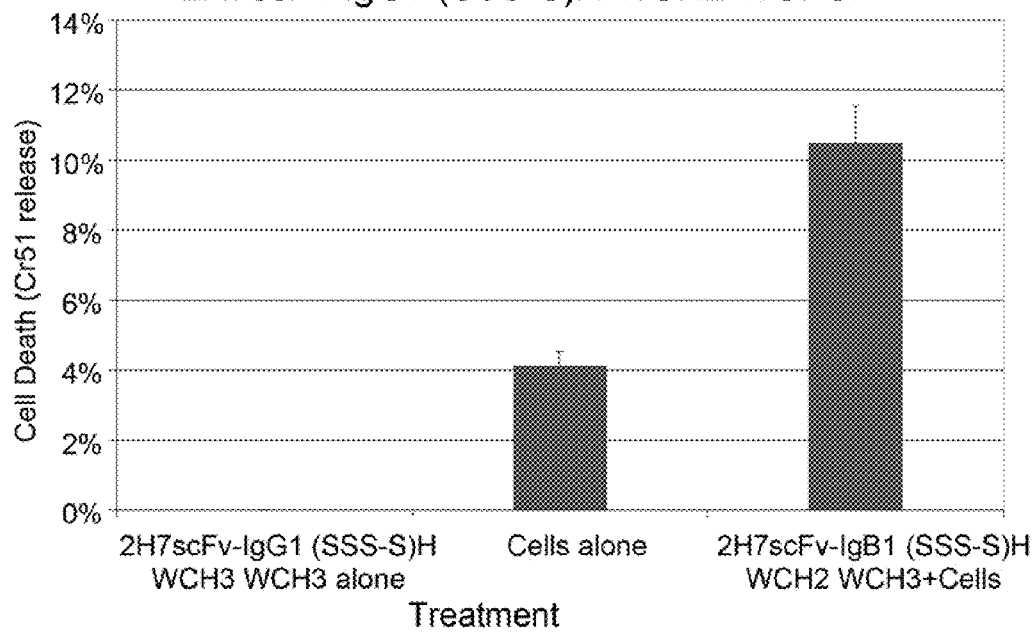

*Fig. 4B*

2H7-CD154 L2 cDNA and predicted amino acid sequence:

```
    HindIII      NcoI     |2H7 V_L Leader Peptide →
    ~~~~~~       ~~~~~~
                           M  D  F  Q  V  Q  I  F  S  F  L  L  I  S  A
  1 AAGCTTGCCG CC    ATGGATTT TCAAGTGCAG ATTTTCAGCT TCCTGCTAAT CAGTGCTTCA

|2H7 V_L →
      V  I  I  A  R  G  Q  I  V  L  S  Q  S  P  A  I  L  S  A  S
 61 GTCATAATTG CCAGAGGACA AATTGTTCTC TCCCAGTCTC CAGCAATCCT GTCTGCATCT

P  G  E  K  V  T  M  T  C  R  A  S  S  S  V  S  Y  M  H  W
121 CCAGGGAGA AGGTCACAAT GACTTGCAGG GCCAGCTCAA GTGTAAGTTA CATGCACTGG

BamHI
                ~~~~~~~~
      Y  Q  Q  K  P  G  S  S  P  K  P  W  I  Y  A  P  S  N  L  A
181 TACCAGCAGA AGCCAGGATC CTCCCCCAAA CCCTGGATTT ATGCCCCATC CAACCTGGCT

S  G  V  P  A  R  F  S  G  S  G  S  G  T  S  Y  S  L  T  I
241 TCTGGAGTCC CTGCTCGCTT CAGTGGCAGT GGGTCTGGGA CCTCTTACTC TCTCACAATC

S  R  V  E  A  E  D  A  A  T  Y  Y  C  Q  Q  W  S  F  N  P
301 AGCAGAGTGG AGGCTGAAGA TGCTGCCACT TATTACTGCC AGCAGTGGAG TTTTAACCCA

| (Gly_3Ser)_3 Linker →
      P  T  F  G  A  G  T  K  L  E  L  K  G  G  G  S  G  G  G
361 CCCACGTTCG GTGCTGGGAC CAAGCTGGAG CTGAAAGGTG GCGGTGGCTC GGGCGGTGGT

|2H7 V_H →
      G  S  G  G  G  S  S  Q  A  Y  L  Q  Q  S  G  A  E  L  V
421 GGATCTGGAG GAGGTGGGAG CTCTCAGGCT TATCTACAGC AGTCTGGGGC TGAGCTGGTG

R  P  G  A  S  V  K  M  S  C  K  A  S  G  Y  T  F  T  S  Y
481 AGGCCTGGGG CCTCAGTGAA GATGTCCTGC AAGGCTTCTG GCTACACATT TACCAGTTAC

N  M  H  W  V  K  Q  T  P  R  Q  G  L  E  W  I  G  A  I  Y
541 AATATGCACT GGGTAAAGCA GACACCTAGA CAGGGCCTGG AATGGATTGG AGCTATTTAT

P  G  N  G  D  T  S  Y  N  Q  K  F  K  G  K  A  T  L  T  V
601 CCAGGAAATG GTGATACTTC CTACAATCAG AAGTTCAAGG GCAAGGCCAC ACTGACTGTA

D  K  S  S  S  T  A  Y  M  Q  L  S  S  L  T  S  E  D  S  A
661 GACAAATCCT CCAGCACAGC CTACATGCAG CTCAGCAGCC TGACATCTGA AGACTCTGCG

V  Y  F  C  A  R  V  V  Y  Y  S  N  S  Y  W  Y  F  D  V  W
721 GTCTATTTCT GTGCAAGAGT GGTGTACTAT AGTAACTCTT ACTGGTACTT CGATGTCTGG
```

Fig. 7A

|human CD154/amino acid 48→

Bcl/Bam hybrid site
~~~~~~~~

```
       G   T   G   T       T   V   T       V   S   D       P   R   R   L       D   K   I       E   D   E
781    GGCACAGGGA  CCACGGTCAC  CGTCTCTGAT  CCAAGAAGGT  TGGACAAGAT  AGAAGATGAA

R   N   L   H       E   D   F       V   F   M       K   T   I   Q       R   C   N       T   G   E
841    AGGAATCTTC  ATGAAGATTT  TGTATTCATG  AAAACGATAC  AGAGATGCAA  CACAGGAGAA

R   S   L   S       L   L   N       C   E   E       I   K   S   Q       F   E   G       F   V   K
901    AGATCCTTAT  CCTTACTGAA  CTGTGAGGAG  ATTAAAAGCC  AGTTTGAAGG  CTTTGTGAAG
                                                                                             BclI
       D   I   M   L       N   K   E       T   K   K       E   N   S   F       E   M   Q   K   G
961    GATATAATGT  TAAACAAAGA  GGAGACGAAG  AAAGAAAACA  GCTTTGAAAT  GCAAAAAGGT
```

BclI
~~~~~~

```
       D   Q   N   P       Q   I   A       A   H   V       I   S   E   A       S   S   K       T   T   S
1021   GATCAGAATC  CTCAAATTGC  GGCACATGTC  ATAAGTGAGG  CCAGCAGTAA  AACAACATCT

V   L   Q   W       A   E   K       G   Y   Y       T   M   S   N       N   L   V       T   L   E
1081   GTGTTACAGT  GGGCTGAAAA  AGGATACTAC  ACCATGAGCA  ACAACTTGGT  AACCCTGGAA

N   G   K   Q       L   T   V       K   R   Q       G   L   Y   Y       I   Y   A       Q   V   T
1141   AATGGGAAAC  AGCTGACCGT  TAAAAGACAA  GGACTCTATT  ATATCTATGC  CCAAGTCACC
```

HindIII
~~~~~~~~

```
       F   C   S   N       R   E   A       S   S   Q       A   P   F   I       A   S   L       C   L   K
1201   TTCTGTTCCA  ATCGGGAAGC  TTCGAGTCAA  GCTCCATTTA  TAGCCAGCCT  CTGCCTAAAG

S   P   G   R       F   E   R       I   L   L       R   A   A   N       T   H   S       S   A   K
1261   TCCCCCGGTA  GATTCGAGAG  AATCTTACTC  AGAGCTGCAA  ATACCCACAG  TTCCGCCAAA

P   C   G   Q       Q   S   I       H   L   G       V   F   E   L       Q   P   G       A   S
1321   CCTTGCGGGC  AACAATCCAT  TCACTTGGGA  GGAGTATTTG  AATTGCAACC  AGGTGCTTCG
```

NcoI
~~~~~~~

```
       V   F   V   N       V   T   D       P   S   Q       V   S   H   G       T   G   F       T   S   F
1381   GTGTTTGTCA  ATGTGACTGA  TCCAAGCCAA  GTGAGCCATG  GCACTGGCTT  CACGTCCTTT
```

XhoI     XbaI
~~~~~~      ~~~~~~

```
       G   L   L   K   L   E   *   *
1441           GGCTTACTCA  AACTCGAGTG  ATAATCTAGA
```

Fig. 7A (continued)

2H7scFv-CD154 S4 cDNA and predicted amino acid sequence:

```
     HindIII      NcoI
     ~~~~~~~      ~~~~~~~~|2H7 V_L Leader Peptide→
                          M   D   F   Q   V   Q   I   F   S   F   L   L   I   S   A   S
  1  AAGCTTGCCG  CC  ATGGATTT TCAAGTGCAG ATTTTCAGCT TCCTGCTAAT CAGTGCTTCA

|2H7 V_L →
     V   I   I   A   R   G   Q   I   V   L   S   Q   S   P   A   I   L   S   A   S
 61  GTCATAATTG CCAGAGGACA AATTGTTCTC TCCCAGTCTC CAGCAATCCT GTCTGCATCT

P   G   E   K   V   T   M   T   C   R   A   S   S   S   V   S   Y   M   H   W
121  CCAGGGGAGA AGGTCACAAT GACTTGCAGG GCCAGCTCAA GTGTAAGTTA CATGCACTGG

BamHI
                 ~~~~~~~
     Y   Q   Q   K   P   G   S   S   P   K   P   W   I   Y   A   P   S   N   L   A
181  TACCAGCAGA AGCCAGGATC CTCCCCCAAA CCCTGGATTT ATGCCCCATC CAACCTGGCT

S   G   V   P   A   R   F   S   G   S   G   S   G   T   S   Y   S   L   T   I
241  TCTGGAGTCC CTGCTCGCTT CAGTGGCAGT GGGTCTGGGA CCTCTTACTC TCTCACAATC

S   R   V   E   A   E   D   A   A   T   Y   Y   C   Q   Q   W   S   F   N   P
301  AGCAGAGTGG AGGCTGAAGA TGCTGCCACT TATTACTGCC AGCAGTGGAG TTTTAACCCA

|(Gly_4Ser)_3 Linker →
     P   T   F   G   A   G   T   K   L   E   L   K   G   G   G   G   S   G   G   G
361  CCCACGTTCG GTGCTGGGAC CAAGCTGGAG CTGAAAGGTG GCGGTGGCTC GGGCGGTGGT

|2H7 V_H →
     G   S   G   G   G   G   S   Q   A   Y   L   Q   Q   S   G   A   E   L   V
421  GGATCTGGAG GAGGTGGGAG CTCTCAGGCT TATCTACAGC AGTCTGGGGC TGAGCTGGTG

R   P   G   A   S   V   K   M   S   C   K   A   S   G   Y   T   F   T   S   Y
481  AGGCCTGGGG CCTCAGTGAA GATGTCCTGC AAGGCTTCTG GCTACACATT TACCAGTTAC

N   M   H   W   V   K   Q   T   P   R   Q   G   L   E   W   I   G   A   I   Y
541  AATATGCACT GGGTAAAGCA GACACCTAGA CAGGGCCTGG AATGGATTGG AGCTATTTAT

P   G   N   G   D   T   S   Y   N   Q   K   F   K   G   K   A   T   L   T   V
601  CCAGGAAATG GTGATACTTC CTACAATCAG AAGTTCAAGG GCAAGGCCAC ACTGACTGTA

D   K   S   S   S   T   A   Y   M   Q   L   S   S   L   T   S   E   D   S   A
661  GACAAATCCT CCAGCACAGC CTACATGCAG CTCAGCAGCC TGACATCTGA AGACTCTGCG

V   Y   F   C   A   R   V   V   Y   Y   S   N   S   Y   W   Y   F   D   V   W
721  GTCTATTTCT GTGCAAGAGT GGTGTACTAT AGTAACTCTT ACTGGTACTT CGATGTCTGG
```

*Fig. 7B*

|human CD154/amino acid 108 →

Bcl/Bam hybrid site

```
         G   T   G   T   T   V   T   V   S   D   P   E   N   S   F   E   M   Q   K   G
781      GGCACAGGGA CCACGGTCAC CGTCTCTGAT CCAGAAAACA GCTTTGAAAT GCAAAAAGGT
```

BclI

```
         D   Q   N   P   Q   I   A   A   H   V   I   S   E   A   S   S   K   T   T   S
841      GATCAGAATC CTCAAATTGC GGCACATGTC ATAAGTGAGG CCAGCAGTAA AACAACATCT

V   L   Q   W   A   E   K   G   Y   Y   T   M   S   N   N   L   V   T   L   E
901      GTGTTACAGT GGGCTGAAAA AGGATACTAC ACCATGAGCA ACAACTTGGT AACCCTGGAA

N   G   K   Q   L   T   V   K   R   Q   G   L   Y   Y   I   Y   A   Q   V   T
961      AATGGGAAAC AGCTGACCGT TAAAAGACAA GGACTCTATT ATATCTATGC CCAAGTCACC
```

HindIII

```
         F   C   S   N   R   E   A   S   S   Q   A   P   F   I   A   S   L   C   L   K
1021     TTCTGTTCCA ATCGGGAAGC TTCGAGTCAA GCTCCATTTA TAGCCAGCCT CTGCCTAAAG

S   P   G   R   F   E   R   I   L   L   R   A   A   N   T   H   S   S   A   K
1081     TCCCCCGGTA GATTCGAGAG AATCTTACTC AGAGCTGCAA ATACCCACAG TTCCGCCAAA

P   C   G   Q   Q   S   I   H   L   G   V   F   E   L   Q   P   G   A   S
1141     CCTTGCGGGC AACAATCCAT TCACTTGGGA GGAGTATTTG AATTGCAACC AGGTGCTTCG
```

NcoI

```
         V   F   V   N   V   T   D   P   S   Q   V   S   H   G   T   G   F   T   S   F
1201     GTGTTTGTCA ATGTGACTGA TCCAAGCCAA GTGAGCCATG GCACTGGCTT CACGTCCTTT
```

XhoI      XbaI

```
         G   L   L   K   L   E   *   *
1261     GGCTTACTCA AACTCGAGTG ATAATCTAGA
```

Fig. 7B (continued)

B Cell Depletion in macaques mediated by Cytox B20 (2H7 scFv IgG1 (SSS-S)H WCH2 WCH3) Construct

- CytoxB20 injections of 6mg/kg yields 3 week B-cell depletion
- 3-4 day half-life *in vivo*
- CD20 saturation in lymph node B-cells at d14
- No first dose effects
- No anti-chimeric antibody development

*Fig. 16*

ADCC Activity of 2H7 scFvIG, G28-1 scFvIg, and HKD37 scFvIg Constructs
ADCC Activity of scFvs Targeted to B Cell Antigens
A. 2H7 (anti-CD20) scFv Derivatives
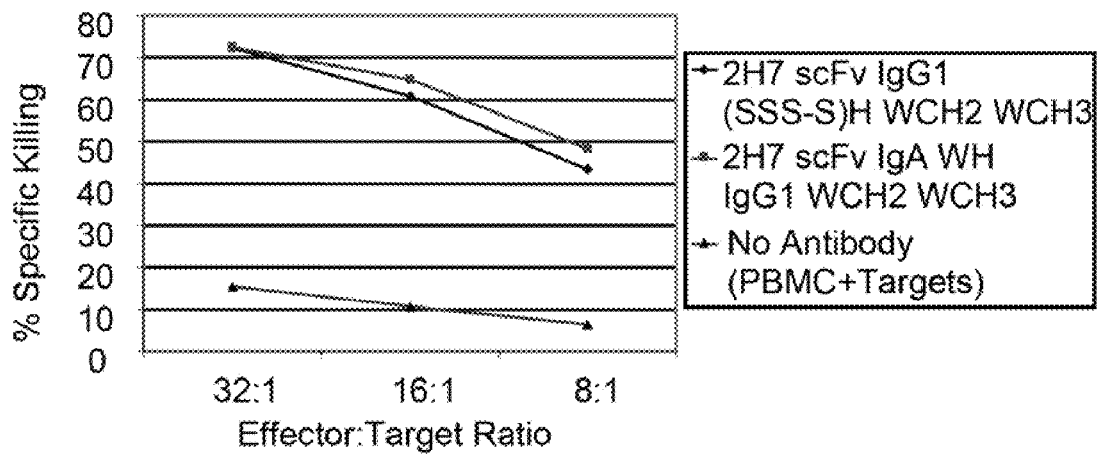
B. G28-1 (anti-CD37) scFv Derivatives
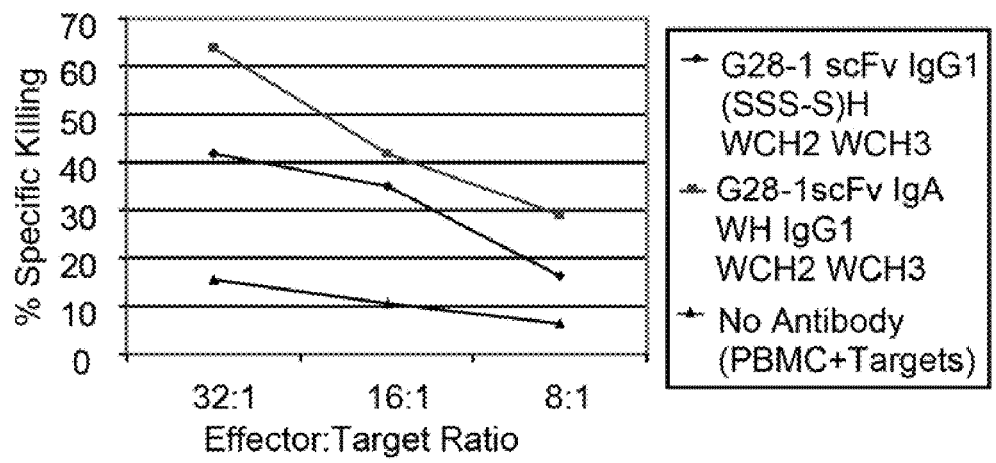
C. HD37 (anti-CD19) scFv Derivatives
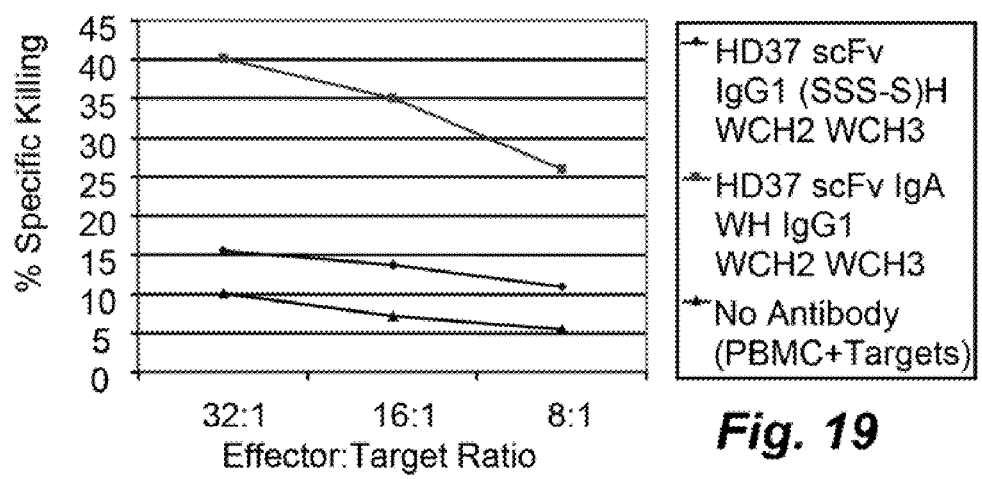
*Fig. 19*

Sequence alignment of human and llama Fc regions

```
               HINGE                    |CH2→
Human IgG1:  DQEPKSCDKT-------------HTCPPC   PAPELLGGPSVFLFPPKPKDTLMISRTPEVTCVVVDVSHEDPEVKFNWYVDG
Llama IgG2:  DQEPKTPKPQPQPQPQPNPTTESKCPKC     PAPELLGGPSVFIFPPKPKDVLSISGRPEVTCVVVDVGQEDPEVSFNWYIDG
Llama IgG1:  ---EPHGG--------------CTCPQC     PAPELPGGPSVFVFPPKPKDVLSISGRPEVTCVVVDVGKEDPEVNFNWYIDG
Llama IgG3:  ---AHHSEDPT-----------SKCPKC     PGPELLGGPTVFIFPPKAKDVLSITRKPEVTCLWWTWVKKTLRSSSSWSVDD

|CH3→
VEVHNAKTKPREEQYNSTYRVVSVLTVLHQDWLNGKEYKCKVSNKALPAPIEKTISKAKGQPREPQVYTLPPSRDELTKNQVSLIT
TAEVRANTRPKEEQFNSTYRVVSVLPIQHQDWLTGKEFKCKVNNKALPAPIEKTISKAKGQTREPQVYTLAPHREELAKDTVSVT
VEVRTANTKPKEEQFNSTYRVVSVLPIQHQDWLTGKEFKCKVNNKALPAPIERTISKAKGQTREPQVYTLAPHREELAKDTVSVT
TEVHTAETKPKEEQFNSTYRVVSVLPIQHQDWLTGKEFKCKVNNKALPAPIERTISKAKGQTREPQVYTLAPHREELAKDTVSVT

CLVKGFYPSDIAVEWESNGQPEN---NYKTTPPVLDSDGSFFLYSKLTVDKSRWQQGNVFSCSVMHEALHNHYTQKSLSLSPGK
CLVKGFYPPDINVEWQRNGQPESXGTYATTPPQLDNDGTYFLXSKXSVGKNTWQQGETFTCVVMHEALHNHYTQKSITQSSGK
CLVKGFYPADINVEWQRNGQPESEGTYANTPPQLDNDGTYFLYSRLSVGKNTWQRGETLTGVVMHEALHNHYTQKSITQSSGK
CLVKGFFPADINVEWQRNGQPESEGTYANTPPQLDNDGTYFLYSKLSVGKNTWQQGEVFTCVVMHEALHNHSTQKSITQSSGK
```

Fig. 23

Ig Constructs and Nomenclature:

| Name Identifier | Hinge Sequence | CH2 Sequence | CH3 Sequence |
|---|---|---|---|
| hIgG1 (CCC-P)H WCH2 WCH3 | IgG1 WT Hinge (CCC-P) | Wild Type CH2 | Wild Type CH3 |
| hIgG1 (SSS-S)H WCH2 WCH3 | IgG1 Mutant Hinge (SSS-S) | Wild type CH2 (IgG1) | Wild type CH3 (IgG1) |
| VH L11S hIgG1 (SSS-S)H WCH2 WCH3 | IgG1 Mutant Hinge (SSS-S) | Wild type CH2 (IgG1) | Wild type CH3 (IgG1) |
| IgG1 (SSC-S)H WCH2 WCH3 | IgG1 Mutant Hinge (SSC-S) | Wild type CH2 (IgG1) | Wild type CH3 (IgG1) |
| IgG1 (SCS-S)H WCH2 WCH3 | IgG1 Mutant Hinge (SCS-S) | Wild type CH2 (IgG1) | Wild type CH3 (IgG1) |
| IgG1 (CSS-S)H WCH2 WCH3 | IgG1 Mutant Hinge (CSS-S) | Wild type CH2 (IgG1) | Wild type CH3 (IgG1) |
| IgG1 (SSS-S)H P238S CH2 WCH3 | IgG1 Mutant Hinge (SSS) | Mutant CH2 (IgG1) Pro→Ser 238 | Wild type CH3 (IgG1) |
| IgA WH hIgG1 WCH2 WCH3 | IgA Hinge | Wild type CH2 (IgG1) | Wild type CH3 (IgG1) |
| IgA WH IgA WCH2 WCH3 | IgA Hinge | Wild type CH2 (IgA) | Wild type CH3 (IgA) |
| IgA WH IgA WCH2 T4CH3 | IgA Hinge | Wild type CH2 (IgA) | Truncated CH3 (IgA) Missing 3 aa at COOH |

*Fig. 31*

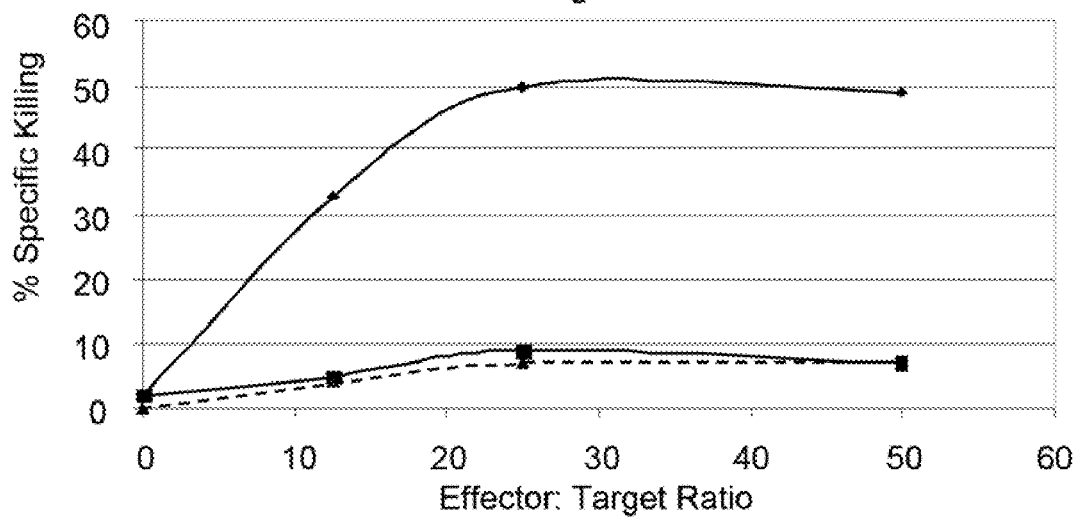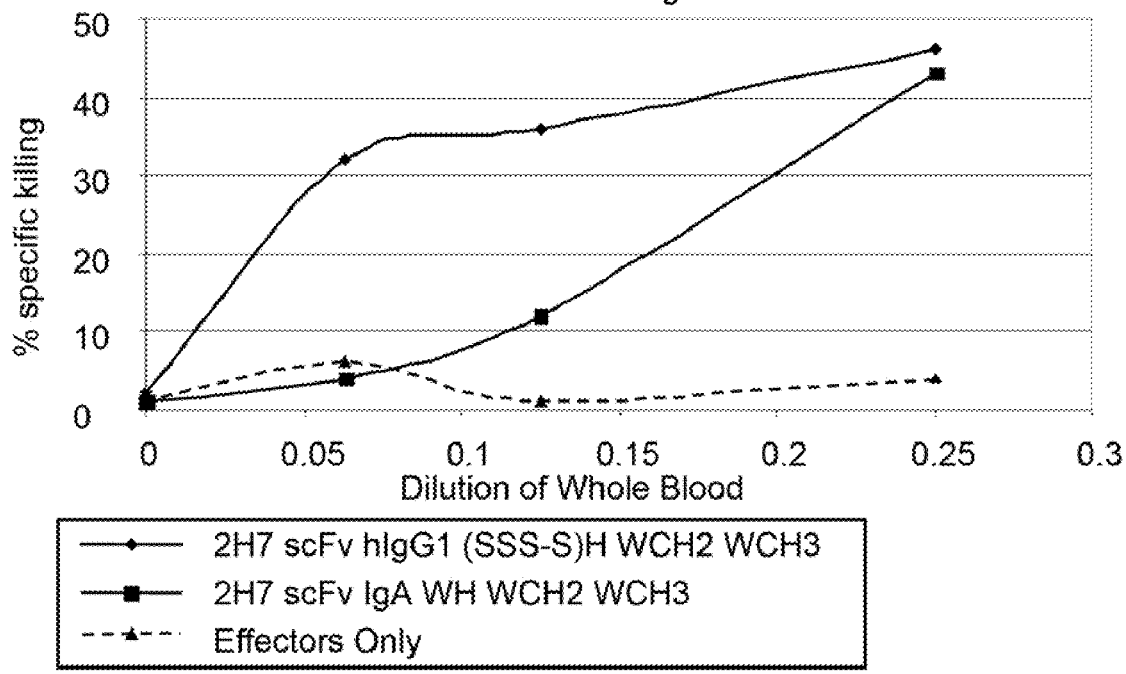
Fig. 39

Cell surface expression of anti-human CD3 G19-4 scFv hIgG1
(SSS-S)H P238SCH2 WCH3-hCD80TM/CT on Reh and T51 Cells.
Reh anti-CD3 (G19-4) scFv hIgG1 (SSS-S)H
P238SCH2 WCH3-hCD80TM/CT
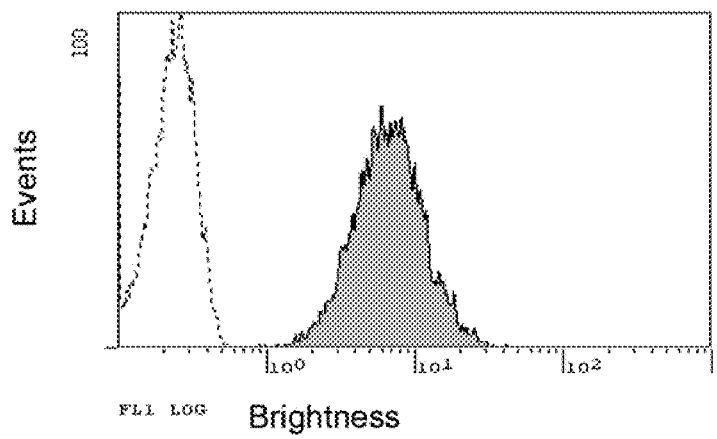
T51 G19-4 scFv hIgG1 (SSS-S)H
P238SCH2 WCH3-hCD80TM/CT:
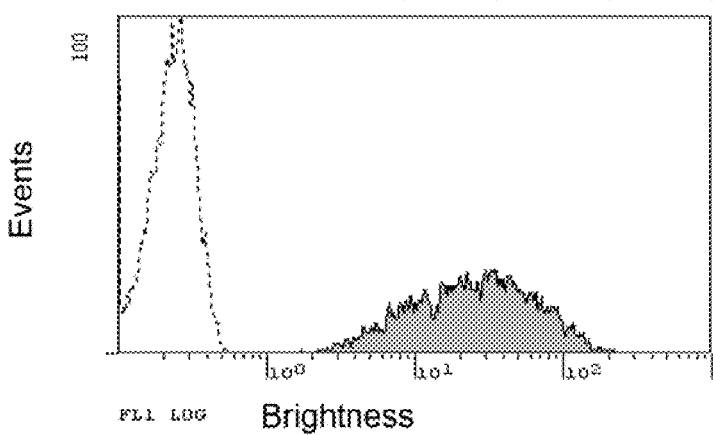
*Fig. 47*

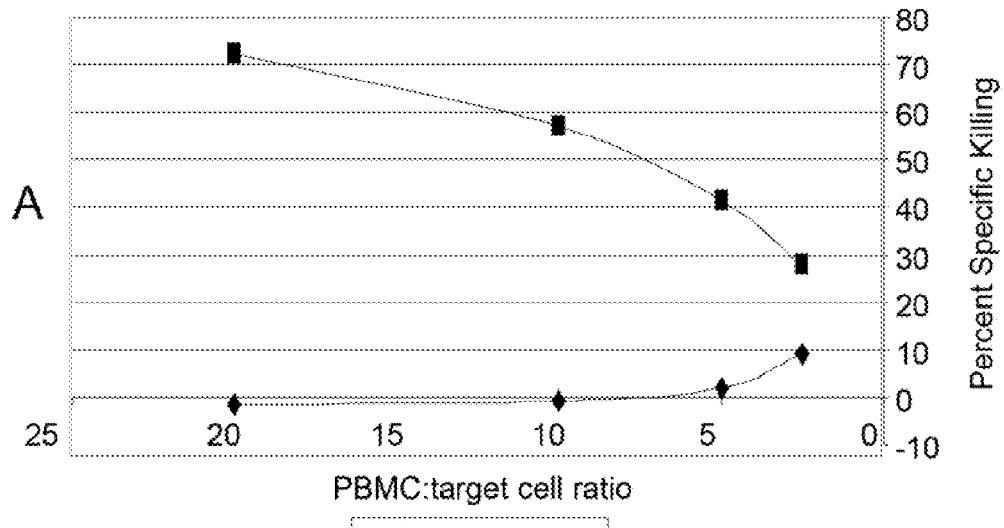
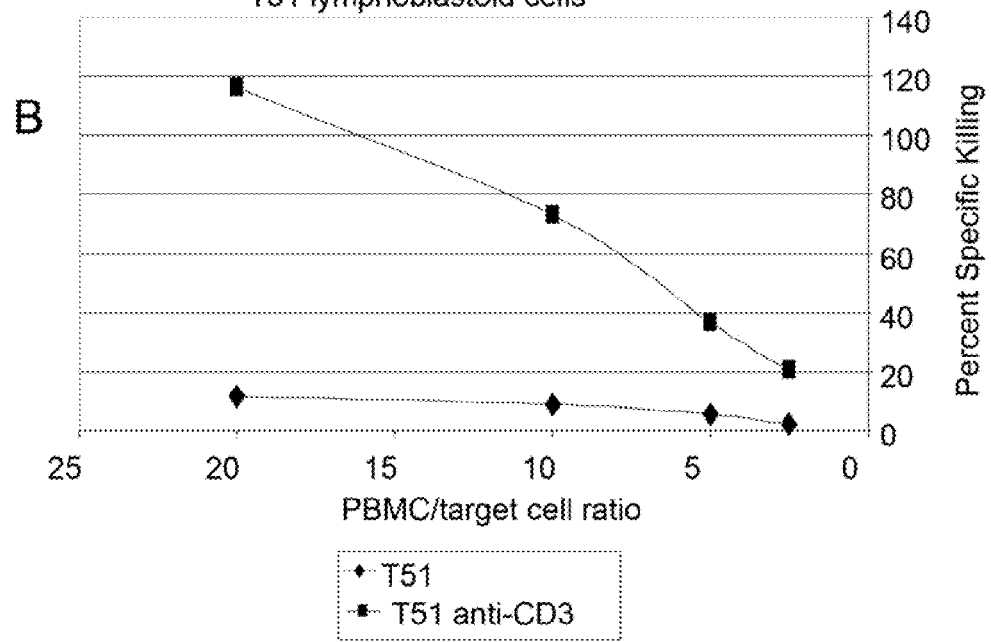
Fig. 48

Effect of V$_H$L11S Mutation on CytoxB20
2H7 scFv hIgG1 (SSS-S)H WCH2 WCH3 Protein Expression
A. Standard Curve: 2H7VH-L11S-IgG1 (SSS-S)H WCH2 WCH3

B. CHO supernatant Brightness and Estimation of
Protein concentrations from Standard Curve:

| | CHO clone name | | | | |
|---|---|---|---|---|---|
| | 4F2 | 4F5 | 3E5 | 6B11A | 2B8A |
| Mean LFE 1/100 | 71.7 | 40.6 | 31.5 | 99.7 | 101.5 |
| 1/500 | 27.1 | 12.4 | 11.2 | 40.8 | 43 |
| approx conc. µg/ml | 600 | 225 | 125 | 1000 | 1250 |

*Fig. 50*

Immunoblot of G28-1 scFvIg Derivatives

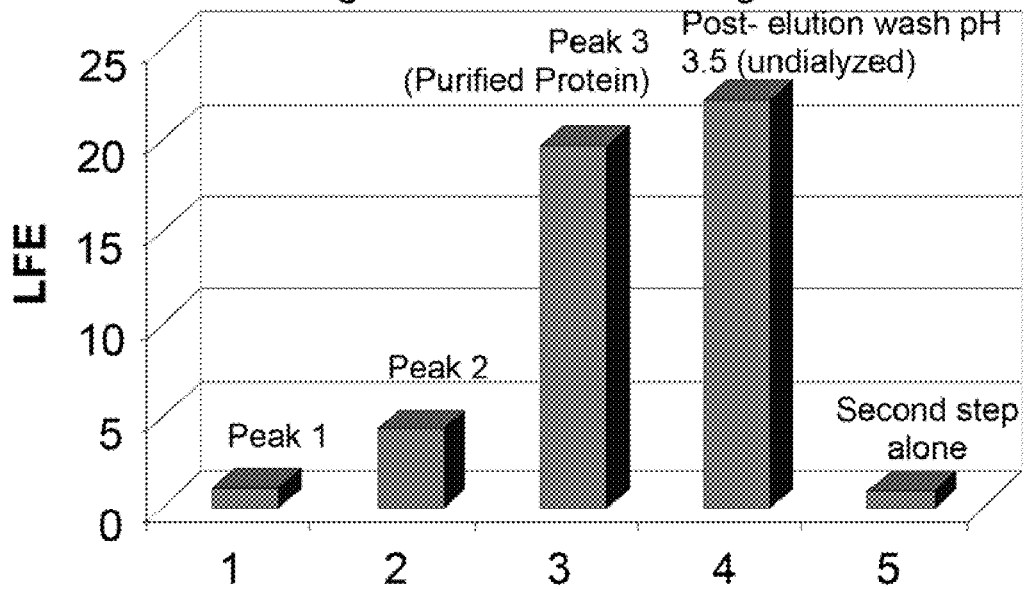
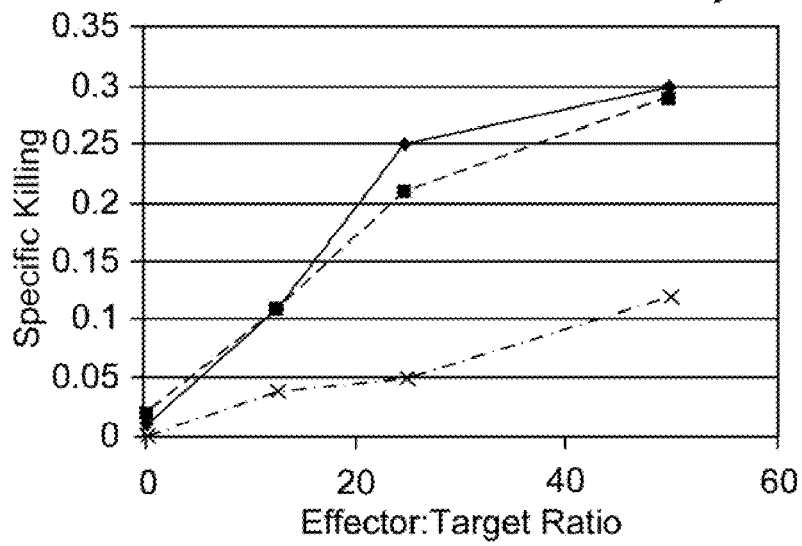
*Fig. 58*

HPLC Profiles of 2H7 scFvIg Constructs
Size Standards: 670  158  44  17  1.35

A
2H7 scFv hIgG1
(SSS-S)H WCH2 WCH3

B
2H7 scFv hIgG1
(CSC-S)H WCH2 WCH3

C
2H7 scFv hIgG1
(CCC-P)H WCH2 WCH3

D
2H7 scFv hIgA WH
hIgG1 WCH2 WCH3

Injection Point (t₀)    Time After Injection

Fig. 61

Binding of FITC Labeled, Recombinant Human CD16(ED) extracellular domain -Ig Fusion Protein to CytoxB Derivatives on CD20 CHO Cells

FITC-CD16 ED(158 V/F) HigG1(SSS-S)H (P238S)CH2 WCH3

CD20+

CytoxB20
2H7 scFv hIgG1

Expression of surface displayed SMIPs links modified cDNAs with the altered fusion proteins scFvIg1
scFvIg2
scFvIg1

Mammalian Cell Transfected With
1. A single surface displayed scFvIg expression construct
OR
2. a library of such molecules

*Fig. 70*

CD37 mAbs and scFvIg Induce Apoptosis

| | Bjab Staining | Annexin V Positive | |
|---|---|---|---|
| scFvIg | No scFvIg | 17.5 | |
| | 2H7 MH | 27 | |
| | G28-1 MH | 30.6 | |
| | G28-1 IgAH | 28.9 | |
| | HD37 MH | 29.1 | |
| | (2H7+G28-1)MH | 41 | |
| | (2H7+HD37) MH | 37.1 | |
| | (G28-1+HD37) MH | 35.3 | |

| | | | plus GAM |
|---|---|---|---|
| | Ramos | AnnexinV Positive | AnnexinV positive |
| mAbs | cells alone | 3 | 3.3 |
| | 2H7 Mab | 1.4 | 3.1 |
| | G28-1 Mab | 18.3 | 8.7 |
| | HD37 Mab | 3.7 | 3.1 |
| | G28-5 | 3.9 | 8.3 |
| | 2H7+G28-1 | 32.3 | 35.7 |
| | 2H7+HD37 | 5 | 10.5 |
| | 2H7+G28-5 | 5.7 | 19.4 |
| | HD37+G28-1 | 26.9 | 50 |
| | HD37+G28-5 | 8.2 | 18.4 |
| | G28-1+G28-5 | 39.5 | 68.3 |

*Fig. 71*

Complement Dependent Cytotoxicity Mediated by CytoxB20G Derivatives

Fig. 73

Binding of CytoxB37G SMIPs to B Cell Lymphoma Cell Lines
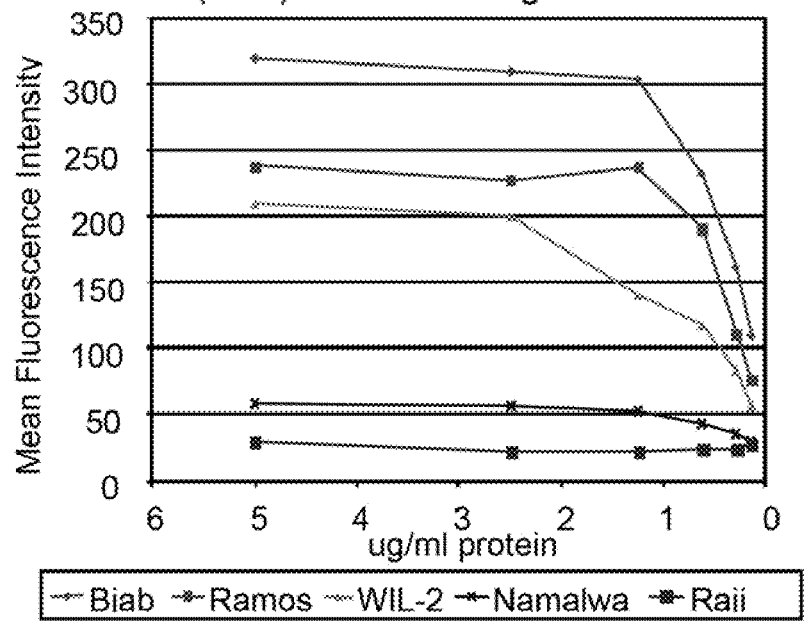
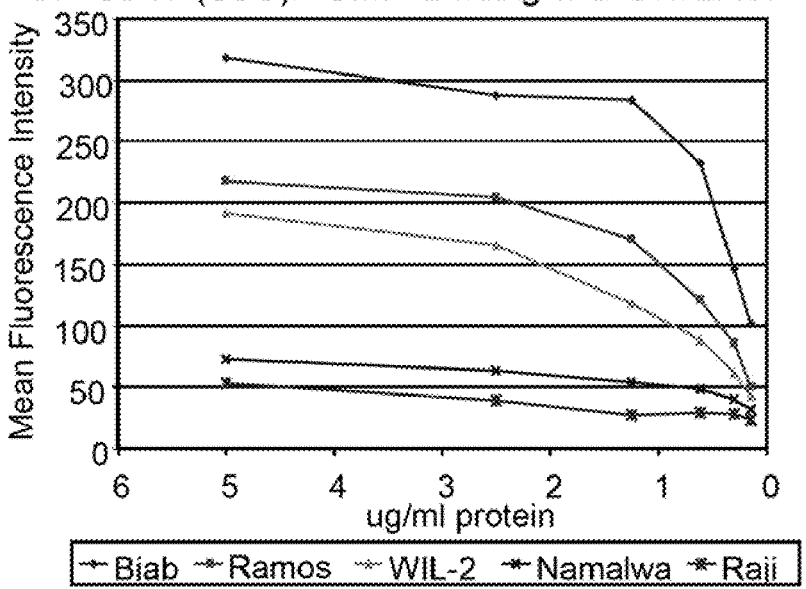
Fig. 79

BINDING CONSTRUCTS AND METHODS FOR USE THEREOF

All applications from which this application takes priority are incorporated herein by reference in their entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 910180_40102USPCa_SEQUENCE_LISTING.txt. The text file is 1304 KB, was created on Mar. 20, 2009, and is being submitted electronically via EFS-Web.

FIELD OF THE INVENTION

The present invention relates generally to compounds having various utilities including uses for research, diagnostics, and therapy, for example, immunotherapy. Compounds of the invention include immunologically active proteins and protein conjugates. Such proteins include recombinant or engineered binding proteins such as, for example, binding domain-immunoglobulin fusion proteins, which may include single chain Fv-immunoglobulin fusion proteins and compounds containing single chain Fv-immunoglobulins. The present invention also relates to compositions and methods for treating conditions, diseases and disorders that would improved, eased, or lessened from the administration of, for example, polypeptide and/or nucleic acid constructs of the invention, including, for example, malignant conditions and B cell disorders, including diseases characterized by autoantibody production and/or inflammation.

BACKGROUND OF THE INVENTION

The immune system is one of the most complex of the body's many intricate systems. A vast and complicated arrangement made up of many different types of cells and involving many different kinds of molecules, the human immune system allows the body to respond to foreign invaders such as bacteria, viruses, and other infectious agents, as well as foreign material such as pollen. In general, the human immune system is divided into two main parts, antibody-mediated immunity (also called "humoral" or "circulating" immunity) and cell-mediated immunity, both of which are managed by lymphocytes. Lymphocytes are one of the five kinds of white blood cells (leukocytes) circulating in the blood. There are several kinds of lymphocytes, each with different functions to perform. The most common types of lymphocytes are B lymphocytes (B cells), which are responsible for making antibodies, and T lymphocytes (T cells). Cells of the immune system not only include T cells and B cells, but also Natural Killer Cells, granulocytes (or polymorphonuclear (PMN) leukocytes), macrophages, and dendritic cells. The humoral system is managed by B cells with help from T cells and deals with infectious agents in the blood and tissues of the body. The cell-mediated system is managed by T cells and deals with cells of the body that have been infected.

An antigen is a substance, usually macromolecular, that stimulates or induces an immune response. Because of its complex macromolecular structure, a single microorganism consists of multiple antigens (e.g., surface structures such as cell wall components, fimbriae, flagella, etc., or extracellular proteins, such as toxins or enzymes produced by the microorganism). The coat proteins and some of the envelope proteins of animal viruses are also usually antigenic. A host is generally able to respond specifically to antigens that come into contact with components of its immune system. Both the antibody-mediated immunity and cell-mediated immunity systems involve complex interrelationships that allow them to mount immune reactions to almost any antigen. In other words, the immune system is able to recognize foreign substances (antigens) that stimulate the system to produce antibody-mediated immunity, cell-mediated immunity, or both.

The immune system complex is constituted by a variety of different cell types and organs disseminated throughout the body. These include the primary and secondary lymphoid organs. The primary lymphoid organs are the bone marrow and the thymus. All the cells of the immune system are initially derived from the bone marrow in a process called hematopoiesis. During hematopoiesis bone marrow-derived stem cells differentiate into either mature cells of the immune system ("B" cells) or into precursors of cells that migrate out of the bone marrow to mature in the thymus ("T" cells). In addition to red blood cells, platelets, and B cells, the bone marrow also produces Natural Killer cells, granulocytes, and immature thymocytes. The function of the thymus is to produce mature T cells. Immature thymocytes, also known as prothymocytes, leave the bone marrow and migrate into the thymus where they mature and are then released into the bloodstream. The immune system complex also includes secondary lymphoid organs, e.g., the spleen, the lymph nodes, etc., as well as a circulatory system that is separate from blood vessels.

The spleen, made up of B cells, T cells, macrophages, dendritic cells, Natural Killer cells, and red blood cells, is an immunologic filter of the blood. Migratory macrophages and dendritic cells capture antigens from blood that passes through the spleen. Migratory macrophages and dendritic cells also bring antigens to the spleen via the bloodstream. An immune response is initiated in the spleen when macrophages or dendritic cells present the antigen to the appropriate B or T cells, and B cells become activated and produce large amounts of antibody.

Lymphatic vessels and lymph nodes are the parts of a special circulatory system that carries lymph. Lymph is a transparent fluid containing white blood cells, chiefly lymphocytes. Lymph bathes the tissues of the body, and is then collected in lymphatic vessels. Lymph nodes dot a network of lymphatic vessels and, when afferent lymph ducts bring lymph-containing antigens into the node, function as an immunologic filter for lymph. Composed mostly of T cells, B cells, dendritic cells, and macrophages, the lymph nodes drain fluid from most tissues. Antigens are filtered out of the lymph in the lymph node before the lymph is returned to the circulation. Macrophages and dendritic cells that capture antigens also present these foreign materials to T and B cells in the lymph nodes, resulting in the stimulation of B cells to develop there into antibody-secreting plasma cells. Antibodies leave the lymph node by the efferent ducts that empty into the blood stream. Lymphocytes can also leave the node by the efferent duct and travel to other sites in the lymphatic system or enter into the blood circulation. A single lymphocyte completes a circuit through the circulating blood and lymphatic systems once every 24 hours.

Tonsils, adenoids, Peyer's patches, and the appendix are also lymphoid tissues. Peyer's patches (masses of lymphocytes) are similar to the tonsils and are found throughout the body, especially in the mucous linings of the digestive and respiratory tracts. It is the function of the phagocytic cells found in Peyer's patches and other lymphatic aggregate follicles to defend the body against, for example, inadequately digested food particles crossing the gut wall and entering the blood, and to attack unwanted foreign invaders while they are still in the bowel.

The major function of B cells is the production of antibodies in response to foreign proteins of bacteria, viruses, and tumor cells. T cells are usually divided into two major groups, namely, the cytotoxic T lymphocytes ("Tc" cells or CTLs) and the helper T cells ("Th" cells or T helper cells). Th cells, also referred to as CD4+ T cells, function to augment or potentiate immune responses by the secretion of specialized factors that activate other white blood cells to fight off infection. They enhance the production of antibodies by B cells. Tc cells, also called CD8+ T cells, can directly kill certain tumor cells, viral-infected cells, and sometimes parasites. Tc cells are also important in down-regulation of immune responses. Both types of T cells often depend on the secondary lymphoid organs (the lymph nodes and spleen) as sites where activation occurs, but they are also found in other tissues of the body, including the liver, lung, blood, and intestinal and reproductive tracts.

Natural Killer cells, often referred to as NK cells, represent another type of lymphocyte and are similar to the Tc cell subset. They function as effector cells that directly kill certain tumors such as melanomas and lymphomas, and viral-infected cells. They are called "natural" killers because, unlike cytotoxic T cells, they do not need to recognize a specific antigen before carrying out their function. While NK cells, unlike the Tc cells, kill their targets without prior activation in the lymphoid organs, NK cells activated by Th cell secretions will kill tumor or viral-infected targets more effectively. NK cells target tumor cells and protect against a wide variety of infectious microbes. In several immunodeficiency diseases, including AIDS, Natural Killer cell function is abnormal. Natural Killer cells may also contribute to immunoregulation by secreting high levels of influential lymphokines.

Some NK cells have surface receptors (FcγRIII, also called CD16) for the Fc portion of the IgG antibody. They bind to target cells through receptors for the Fc portion of an antibody that has reacted with antigen on a target cell. This type of cell-mediated immunity is called antibody-dependent cell-mediated cytotoxicity (ADCC). NK cells may also have receptors for the C3 component of complement, another immune defense system, and therefore recognize cells that are coated with C3 as targets. ADCC is thought to be an important defense against a variety of parasitic infections caused, for example, by protozoa and helminths.

Although small lymphocytes look identical, they can be distinguished by molecules carried on their cell surface. Not only do such markers distinguish between B cells and T cells, they distinguish among various subsets of cells that behave differently. Every mature T cell, for instance, carries a marker known as T3 (or CD3). In addition, most helper T cells carry a T4 (CD4) marker, a molecule that recognizes Class II major histocompatibility complex ("MHC") antigens. A molecule known as T8 (CD8), which recognizes Class I MHC antigens, is found on many suppressor/cytotoxic T cells.

Another group of white blood cells collectively referred to as granulocytes, or polymorphonuclear leukocytes (PMNs), is composed of three cell types. These cells, neutrophils, eosinophils, and basophils are important in the removal of bacteria and parasites from the body. Neutrophils migrate through capillary walls and into infected tissue where they kill invaders (e.g., bacteria) and then engulf the remnants by phagocytosis. Eosinophils are cytotoxic, releasing the contents of their granules on an invader. Basophils leave the blood and accumulate at the site of an infection or other inflammation and discharge the contents of their granules, releasing a variety of mediators such as histamine, serotonin, prostaglandins and leukotrienes that, for example, increase blood flow to the area. Mediators released by basophils also play an important part in some allergic responses such as hay fever and anaphylactic responses to insect stings.

Monocytes are large phagocytic white blood cells released from the bone marrow into the blood circulation. When a monocyte enters tissue, it develops into a macrophage. Macrophages are also large, phagocytic cells that engulf foreign material (antigens) that enter the body, as well as dead and dying cells of the body. Macrophages are important in the regulation of immune responses, and are often referred to as scavengers, or antigen-presenting cells (APCs) because they pick up and ingest foreign materials and present these antigens to other cells of the immune system such as T cells and B cells. This is one of the important first steps in the initiation of an immune response. Stimulated macrophages exhibit increased levels of phagocytosis and also secrete Interleukin-1 (IL-1), a product that helps to activate B cells and T cells.

Dendritic cells also originate in the bone marrow and function as APCs. They are usually found in the structural compartment of lymphoid organs such as the thymus, lymph nodes and spleen, but are also found in the bloodstream and other tissues. It is believed that dendritic cells capture antigen or bring it to the lymphoid organs where an immune response is initiated.

Important features of the immunological system relevant to host defense and/or immunity to pathogenic microorganisms include specificity, memory, and tolerance. It is understood, for example, that an antibody or reactive T cell will react specifically with the antigen that induced its formation; it will not react with other antigens. Generally, this specificity is of the same order as that of enzyme-substrate specificity or receptor-ligand specificity, although cross-reactivity is possible. The specificity of the immune response is explained by clonal selection. During the primary immune response, a specific antigen selects a pre-existing clone of specific lymphocytes and stimulates its activation, proliferation and differentiation. It is also understood that once the immune system has responded to produce a specific type of antibody or reactive T cell, it is capable of producing more of the antibody or activated T cell more rapidly and in larger amounts; this is called the secondary (or memory) response. It is also recognized that an animal generally does not undergo an immunological response to its own (potentially-antigenic) components. The animal is said to be tolerant, or unable to react to its own potentially antigenic components. This ensures that under normal conditions, an immune response to "self" antigens (called an autoimmune response) does not occur. Tolerance is brought about in a number of ways, but in essence the immune system is able to distinguish "self" components from "non-self" (foreign) antigens; it will respond to "non-self" but not to "self". Sometimes in an animal, tolerance can be "broken", which may result in an autoimmune disease.

The biological activities of the antibody-mediated and cell-mediated immune responses are different and vary from one type of infection to another. There are several classes or types of antibodies (and subclasses of various types) involved in antibody-mediated immunity. All of the classes of antibodies that are produced in response to a specific antigen react stereochemically with that antigen and not with other (different) antigens. The host has the genetic capacity to produce specific antibodies to thousands of different antigens, but does not do so until there is an appropriate (specific) antigenic stimulus.

Due to clonal selection, the host produces only the homologous antibodies that will react with that antigen which, as noted above, are found in blood (plasma), lymph, and many extravascular tissues. Once the antibody-mediated immunity response occurs following interaction of B lymphocytes with antigen and their differentiation into antibody-secreting plasma cells, the secreted antibody binds to the antigen which, in turn, results in its neutralization or elimination from the body.

Cell-mediated immunity, on the other hand, is mediated by specific subpopulations of T-lymphocytes called effector T cells that exist in precursor form as "resting T cells" (pT cells). These cells bear receptors for specific antigens and recognize these antigens on the surfaces of other cells. Stimulation with that antigen results in T cell activation. T cells enlarge, enter into a mitotic cycle, reproduce and develop into effector T cells whose activities are responsible for this type of immunity. They also develop into clones of identical reactive T cells called memory T cells. As noted above, most of the T cells in the body belong to one of two subsets and are distinguished by the presence on their surface of one or the other of two glycoproteins designated CD4 and CD8. Which of these molecules is present determines the types of cells to which the T cell can bind. T cells bearing CD8 (CD8' T cells) always recognize antigen in association with Class I MHC proteins and typically function as cytotoxic T cells. Almost all the cells of the body express Class I MHC molecules. T cells bearing CD4 (CD4' T cells) always recognize antigens in association with Class II MHC proteins on the surfaces of other cells. Only specialized antigen-presenting cells express Class II MHC molecules, including dendritic cells, phagocytic cells such as macrophages, and B cells. CD4' T lymphocytes generally function as T helper cells.

T helper cells, which include Th1 cells and Th2 cells, respond to antigen with the production of lymphokines Th1 and Th2 cells can be distinguished based on their lymphokine profiles. Like all T cells, Th cells arise in the thymus. When they are presented with an antigen by antigen-presenting dendritic cells they begin to proliferate and become activated. There are two kinds of dendritic cell, DC1 cells (descended from monocytes) and DC2 cells (which appear to be derived from lymphocytes).

Th1 cells (inflammatory Th1 cells involved in the elimination of pathogens residing intracellularly in vesicular compartments) are produced when DC1-type dendritic cells present antigen to the T cell receptor for antigen (TCR) and secrete Interleukin 12 (IL-12). This paracrine stimulation activates Th1 cells to secrete their own lymphokines, in particular, Tumor-Necrosis Factor-beta (TNF-β) (also known as lymphotoxin) and Interferon-gamma (IFN-γ). These lymphokines stimulate macrophages to kill bacteria they have engulfed by phagocytosis and they recruit other leukocytes to the site producing inflammation. Th1 cells are essential for cell-mediated immunity and for controlling intracellular pathogens such as, for example, *Listeria* and *Mycobacterium tuberculosis*.

Th2 cells ("true" helper Th2 cells, which are required for antibody production by B cells) are produced when DC2-type dendritic cells present antigen to the T cell receptor for antigen and, presumably, one or more paracrine stimulants. The major lymphokines secreted by Th2 cells are Interleukin 4 (IL-4), which stimulates class-switching in B cells and promotes their synthesis of IgE antibodies, acts as a positive-feedback device promoting more pre-Th cells to enter the Th2 pathway, and blocks expression of the IL-12 receptor thereby inhibiting pre-Th cells in the thymus from entering the Th1 pathway. IL-4 also causes B cells to proliferate and differentiate into antibody-secreting plasma cells and memory B cells. IL-4 activates only B cells in the vicinity which themselves have bound the antigen, and not others, so as to sustain the specificity of the immune response. Th2 cells also produce Interleukin 5 (IL-5, which attracts and activates eosinophils), Interleukin 10 (IL-10, which inhibits IL-12 production by DCs and prevents maturation of pre-Th cells to Th1 cells), and Interleukin 13 (IL-13, which also promotes the synthesis of IgE antibodies).

Activation of the Th2 cell also causes it to begin to produce Interleukin 2 (IL-2), and to express a membrane receptor for IL-2. The secreted IL-2 autostimulates proliferation of Th2 cells. For example, IL-2 binds to IL-2 receptors on other T cells (which have bound the antigen) and stimulates their proliferation. In addition to IL-2, stimulated Th2 cells also produce IFN-γ and Interleukin 6 (IL-6), which mediate various aspects of the immune response. IFN-γ activates Natural Killer cells to their full cytolytic potential, and is an activator of macrophages and thus increases their antitumor activities. If the macrophages are infected by intracellular parasites, it activates macrophages, which in turn destroy the parasites. IFN-γ also reinforces the antitumor activities of the cytotoxic lymphocytes, increases the nonspecific activities of NK-cells, and is one of the factors that controls the differentiation of B cells and increases the secretion of immunoglobins. IL-6 stimulates several types of leukocytes, as well as the production of Acute Phase Proteins in the liver. It is particularly important in inducing B cells to differentiate into antibody forming (plasma) cells. Thus, Th2 cells provide help for B cells and are essential for antibody-mediated immunity.

Cytotoxic T lymphocytes are able to kill cells that show a new or foreign antigen on their surface (for example, virus-infected cells, or tumor cells, or transplanted tissue cells). The CD8+ CTLs also come in two subsets: Tc1 that, like Th1 cells, secrete IFN-γ, and Tc2 that, like Th2 cells, secrete IL-4.

The cell-mediated immunity response also plays a role in destruction of tumor cells and in rejection of tissue transplants in animals. A major problem in tissue transplantation is rejection, which is often based on cell-mediated immunity response to "foreign" cells (because they are not a perfect antigenic match). Because tumor cells contain specific antigens not seen on normal cells they also may be recognized as foreign and destroyed by the forces of cell-mediated immunity. If tumor cells develop on a regular basis in animals, it may be cell-mediated immunity that eliminates them or holds them in check. The increase in the incidence of many types of cancer (tumors) in humans with advancement of age may be correlated with a decline in the peak efficiency of the immune system that occurs about 25 years of age.

A summary of the types of cells involved in the expression of cell-mediated immunity follows. Tc lymphocytes kill cells bearing foreign antigen on surface in association with Class I MHC and can kill cells that are harboring intracellular parasites (either bacteria or viruses) as long as the infected cell is displaying a microbial antigen on its surface. Tc cells kill tumor cells and account for rejection of transplanted cells. Tc cells recognize antigen-Class I MHC complexes on target cells, contact them, and release the contents of granules directly into the target cell membrane that lyses the cell. Th lymphocytes produce lymphokines that are "helper" factors for development of B cells into antibody-secreting plasma cells. They also produce certain lymphokines that stimulate the differentiation of effector T lymphocytes and the activity of macrophages. Th1 cells recognize antigen on macrophages in association with Class II MHC and become activated (by IL-1) to produce lymphokines including IFN-γ that activates macrophages and NK cells. These cells mediate various aspects of the cell-mediated immunity response including delayed-type hypersensitivity reactions. Th2 cells recognize antigen in association with Class II MHC on an APC and then produce interleukins and other substances that stimulate specific B cell and T cell proliferation and activity. Macrophages are important as antigen-presenting cells that initiate T cell interactions, development, and proliferation. Macrophages are also involved in expression of cell-mediated immunity because they become activated by IFN-γ produced in a cell-mediated immunity response. Activated macrophages have increased phagocytic potential and release soluble substances that cause inflammation and destroy many bacteria and other cells. Natural Killer cells are cytotoxic cells that lyse cells bearing new antigen regardless of their MHC type and even lyse some cells that bear no MHC proteins. NK cells are defined by their ability to kill cells displaying a foreign antigen (e.g., tumor cells) regardless of MHC type and regardless of previous sensitization (exposure) to the antigen. NK cells can be activated by IL-2 and IFN-γ, and lyse cells in the same manner as cytotoxic T lymphocytes. Some NK cells have receptors for the Fc domain of the IgG antibody and are thus able to bind to the Fc portion of IgG on the surface of a target cell and release cytolytic components that kill the target cell via antibody-dependent cell-mediated cytotoxicity.

Extracellular factors that affect cell proliferation and differentiation have been defined as cytokines. These include the lymphokines, which are proteins produced by T-lymphocytes that have effects on the differentiation, proliferation, and activity of various cells involved in the expression of cell-mediated immunity. In general, lymphokines function by (1) focusing circulating leukocytes and lymphocytes into the site of immunological encounter; (2) stimulating the development and proliferation of B cells and T cells; (3) stimulating and preparing macrophages for their phagocytic tasks; (4) stimulating Natural Killer cells; and (5) providing antiviral cover and activity. A summary of various important lymphokines follows. Initially referred to as lymphocyte activation factor, IL-1 is mainly a product of macrophages, and has a variety of effects on various types of cells. It acts as a growth regulator of T cells and B cells, and it induces other cells such as hepatocytes to produce proteins relevant to host defense. IL-1 forms a chemotactic gradient for neutrophils and serves as an endogenous pyrogen that produces fever. Thus, IL-1 plays an important role in both the immune responses and in the inflammatory response. IL-2 stimulates the proliferation of T cells and activates NK cells. IL-3 regulates the proliferation of stem cells and the differentiation of mast cells. IL-4 causes B cell proliferation and enhanced antibody synthesis. IL-6 (also referred to as Interferon-beta2, hybridoma growth factor, B-cell differentiation factor, and hepatocyte stimulatory factor) has effects on B cell differentiation and on antibody production and on T cell activation, growth, and differentiation, and probably has a major role in the mediation of the inflammatory and immune responses initiated by infection or injury. IL-8 is a chemotactic attractant for neutrophils. IL-13 shares many of the properties of IL-4, and is a potent regulator of inflammatory and immune responses. IFN-γ is produced by T cells and may be considered a lymphokine It is sometimes called "immune interferon" (Interferon-alpha being referred to as "leukocyte interferon" and Interferon-beta being referred to as "fibroblast interferon"). IFN-γ has several antiviral effects including inhibition of viral protein synthesis in infected cells. It also activates macrophages and NK cells, and stimulates IL-1, IL-2, and antibody production. Lymphotoxins include the Tumor Necrosis Factors. T cells produce TNF-beta, while TNF-alpha is produced by T cells as well as other types of cells. TNFs function to kill cells, including tumor cells (at a distance). There are several Colony Stimulating Factors (CSFs), including granulocyte macrophage colony stimulating factor (GMCSF), which cause phagocytic white cells of all types to differentiate and divide.

The nature of the membrane receptors for antigen on B cells and T cells is fairly well understood. Each B cell has approximately $10^5$ membrane-bound antibody molecules (IgD or IgM) that correspond in specificity to the antibody the cell is programmed to produce (these receptors being referred to as BCRs). CD32 (FcγRII) on B cells are receptors for the Fc region of IgG. CD21 and CD35 on B cells are receptors for complement components. Each T cell has about $10^5$ molecules of a specific antigen-binding T cell receptor (a TCR) exposed on its surface. The TCR is similar, but not identical, to an antibody. There are two types of T cells that differ in their TCRs, alpha/beta ($\alpha\beta$) T cells and gamma/delta ($\gamma\epsilon$) T cells. The TCR of alpha/beta T cells binds a bimolecular complex displayed by a Class I MHC molecule at the surface of an antigen-presenting cell. As noted above, most Th cells express CD4, whereas most Tc cells express CD8.

Both BCRs and TCRs are similar in that they are integral membrane proteins, they are present in thousands of identical copies exposed at the cell surface, they are made before the cell ever encounters an antigen, they are encoded by genes assembled by the recombination of segments of DNA, they have a unique binding site that binds through non-covalent forces to a portion of the antigen called an epitope (or antigenic determinant) that depends on complementarity of the surface of the receptor and the surface of the epitope, and successful binding of the antigen receptor to the epitope, if accompanied by additional signals, results in stimulation of the cell to leave $G_0$ and enter the cell cycle and repeated mitosis that leads to the development of a clone of cells bearing the same antigen receptor, i.e., a clone of cells of the identical specificity. BCRs and TCRs differ in their structure, the genes that encode them, and the type of epitope to which they bind.

Induction of a primary immune response begins when an antigen penetrates epithelial surfaces. It will eventually come into contact with macrophages or certain other classes of antigen presenting cells, including B cells, monocytes, dendritic cells, Langerhans cells, and endothelial cells. Antigens, such as bacterial cells, are internalized by endocytosis and "processed" by APCs, then "presented" to immunocompetent lymphocytes to initiate the early steps of the immunological response. Processing by a macrophage (for example) results in attaching antigenic materials to the surface of the membrane in association with Class II MHC molecules on the surface of the cell. The antigen-class II MHC complex is presented to a T-helper (Th2) cell, which is able to recognize processed antigen associated with a Class II MHC molecule on the membrane of the macrophage. This interaction, together with stimulation by IL-1 from secreted by the macrophage, will activate the Th2 cell.

As indicated above, B cells themselves behave as APCs. Cross-linked antigens bound to antibody receptors on the surface of a B cell cause internalization of some of the antigen and expression on the B cell membrane together with Class II MHC molecules. The Th2 cell recognizes the antigen together with the Class II MHC molecules, and secretes the various lymphokines that activate the B cells to become antibody-secreting plasma cells and memory B cells. Even if the antigen cannot cross-link the receptor, it may be endocytosed by the B cell, processed, and returned to the surface in association with Class II MHC where it can be recognized by specific Th2 cells which will become activated to initiate B cell differentiation and proliferation. In any case, the overall B cell response leads to antibody-mediated immunity.

The antigen receptors on B cell surfaces are thought to be the specific types of antibodies that they are genetically programmed to produce. Hence, there are thousands of subpopulations of B cells distinguished by their ability to produce a unique antibody molecule. B cells can also react with a homologous antigen on the surface of the macrophage, or with soluble antigens. When a B cell is bound to antigen, and simultaneously is stimulated by IL-4 produced by a nearby Th2 cell, the B cell is stimulated to grow and divide to form a clone of identical B cells, each capable of producing identical antibody molecules. The activated B cells further differentiate into plasma cells which synthesize and secrete large amounts of antibody, and into memory B cells. The antibodies produced and secreted by the plasma cells will react specifically with the homologous antigen that induced their formation. Many of these reactions lead to host defense and to prevention of reinfection by pathogens. Memory cells play a role in secondary immune responses. Plasma cells are relatively short-lived (about one week) but produce large amounts of antibody during this period. Memory cells, on the other hand, are relatively long-lived and upon subsequent exposure to antigen they become quickly transformed into antibody-producing plasma cells.

Generation of cell mediated immunity begins when, for example, a cytotoxic T cell recognizes a processed antigen associated with Class I MHC on the membrane of a cell (usually an altered self cell, but possibly a transplanted tissue cell, or a eukaryotic parasite). Under stimulation by IL-2 produced by Th2 cells, the Tc cell becomes activated to become a cytotoxic T lymphocyte capable of lysing the cell which is showing the new foreign antigen on its surface, a primary manifestation of cell-mediated immunity. The interaction between an antigen-presenting macrophage and a Th cell stimulates the macrophage to produce and secrete a Interleukin-1 that acts locally on the Th cell, stimulating the Th-cell to differentiate and produce its own cytokines (which may here be called lymphokines because they arise from a lymphocyte). These lymphokines have various functions. IL-4 has an immediate effect on nearby B cells. IL-2 has an immediate effect on T cells as described above.

Leucocytes also express adhesion-promoting receptors that mediate cell-cell and cell-matrix interactions. These adhesive interactions are crucial to the regulation of haemopoiesis and thymocyte maturation, the direction and control of leucocyte traffic and migration through tissues, and the development of immune and non-immune inflammatory responses. Several families of adhesion receptors have been identified. The leucocyte integrin family comprises three alpha-beta heterodimeric membrane glycoproteins that share a common beta subunit, designated CD18. The alpha subunits of each of the three members, lymphocyte function associated antigen-1 (LFA-1), macrophage antigen-1 (Mac-1) and p150, are designated CD11a, b, and c respectively. These adhesion molecules play a critical part in the immune and inflammatory responses of leucocytes. The leucocyte integrin family is, in turn, part of the integrin superfamily, members of which are evolutionally, structurally and functionally related. Another integrin subfamily found on leucocytes is the VLA group, so-called because the "very late activation antigens" VLA-1 and VLA-2 were originally found to appear late in T-cell activation. Members of this family function mainly as extracellular matrix adhesion receptors and are found both on haemopoietic and non-haemopoietic cells. They play a part in diverse cellular functions including tissue organization, lymphocyte recirculation and T-cell immune responses. Another integrin subfamily, the cytoadhesins, are receptors on platelets and endothelial cells that bind extracellular matrix proteins. A second family of adhesion receptors is the immunoglobulin superfamily, members of which include CD2, LFA-3, and ICAM-1, which participate in T-cell adhesive interactions, and the antigen-specific receptors of T and B cells, CD4, CD8, and the MHC Class I and II molecules. Another recognized family of adhesion receptors is the selectins, characterized by a common lectin domain. Leucocyte adhesion molecule-1 (LAM-1), which is the human homologue of the murine homing receptor, MEL-14, is expressed on leucocytes, while endothelial leucocyte adhesion molecule-1 (ELAM-1) and granule membrane protein (GMP-140) are expressed on stimulated endothelial cells and activated platelets.

Activation of an immune response requires physical cell-cell contact in addition to cytokines. Thus, for example, development of B and T cell precursors require intimate contact with stromal cells. At least three critical cell-cell contact events are required for the generation of immune responses. The first is initial contact of a specific antigen with a naive T cell. Because of the requirement for MHC presentation, this is an obligate cell contact event. In normal situations the critical antigen presenting cell is the dendritic cell. In addition to the MHC/peptide-TCR interaction there are other non-antigen specific membrane bound ligand-receptor pairs that are important for the dendritic cell-T cell interaction. The principal one is the association of the CD28 molecule on the T cell with either of two ligands, B7.1 (CD80) and B7.2 (CD86), on the dendritic cell. These molecules are termed accessory molecules and it is understood that the CD28 molecule delivers an essential second signal to the T cell without which the T cell does not become activated.

A second essential cell-cell contact is between the activated T cell and an antigen-specific B cell. Most antigens are T cell-dependent, that is, an antibody response to the antigen absolutely requires T cell help. This help is delivered both by cytokines and by cell-cell contact. Cells bind specific antigen via surface Ig, then internalize, process, and present it on Class II MHC molecules. This enables them to be recognized by T cells specific for helper epitopes from the specific antigen. This cell-cell interaction also requires CD28 binding to B7 on the B cell. In addition, a molecule called CD40 ligand or CD154, the expression of which is induced upon T cell activation, binds to CD40 on B cells. CD40 crosslinking promotes B cell proliferation, prevents apoptosis of germinal-center B cells, and promotes immunoglobulin isotype switching. The CD28-B7 and CD40-CD40L receptor ligand interactions are both essential for the dialogue between B and T cells that causes their mutual activation.

A third cell-cell interaction that is essential in immune responses is the binding of activated B cells (which have migrated into a specialized structure in lymphoid organs called germinal centers) to follicular dendritic cells (FDCs). FDCs are specialized stromal cells that hold intact, i.e., unprocessed, antigen on their surface in the form of long-lived immune complexes. Among other molecules, FDCs express CD23, which binds to germinal center B cells via a CR2 receptor and stimulates differentiation to plasma cells.

Time is required before a primary immune response is effective as a host defense. Antigens have to be recognized, taken up, digested, processed, and presented by APCs. A few select Th cells must react with antigen and respond; preexisting B or T lymphocytes must encounter the antigen and proliferate and differentiate into effector cells (plasma cells or Tc cells). In the case of antibody-mediated immunity, antibody level has to build up to an effective physiological concentration to render its host resistant. It may take several days or weeks to reach a level of effective immunity, even though this immunity may persist for many months, or years, or even a lifetime, due to the presence of the antibodies. In natural infections, the inoculum is small, and even though the antigenic stimulus increases during microbial replication, only small amounts of antibody are formed within the first few days, and circulating antibody is not detectable until about a week after infection.

With regard to induction of a secondary immune response, it is understood that on re-exposure to microbial antigens (secondary exposure to antigen), there is an accelerated immunological response, i.e., the secondary or memory response. Larger amounts of antibodies are formed in only 1-2 days. This is due to the activities of specific memory B cells or memory T cells which were formed during the primary immune response. These memory cells, when stimulated by homologous antigen, "remember" having previously seen the antigen, and are able to rapidly divide and differentiate into effector cells. Stimulating memory cells to rapidly produce very high (effective) levels of persistent circulating antibodies is the basis for giving "booster"-type vaccinations to humans and pets. Thus, following the first exposure to an antigen the immune response (as evidenced by following the concentration of specific antibody in the serum) develops gradually over a period of days, reaches a low plateau within 2-3 weeks, and usually begins to decline in a relatively short period of time. When the antigen is encountered a second time, a secondary (memory) response causes a rapid rise in the concentration of antibody, reaching a much higher level in the serum, which may persist for a relatively long period of time. A protective level of antibody may be reached by primary exposure alone, but usually to ensure a high level of protective antibody that persists over a long period of time, it is necessary to have repeated antigenic stimulation of the immune system.

An immunoglobulin molecule (abbreviated Ig), is a multimeric protein composed of two identical light chain polypeptides and two identical heavy chain polypeptides ($H_2L_2$) that are joined into a macromolecular complex by interchain disulfide bonds, i.e., covalent bonds between the sulfhydryl groups of neighboring cysteine residues. There are various classes of human antibody proteins, each of which is produced by a specific clone of plasma cells. Five human immunoglobulin classes are defined on the basis of their heavy chain composition, and are named IgG, IgM, IgA, IgE, and IgD. The IgG-class and IgA-class antibodies are further divided into subclasses, namely, IgG1, IgG2, IgG3, and IgG4, and IgA1 and IgA2. Intrachain disulfide bonds join different areas of the same polypeptide chain, which results in the formation of loops that, along with adjacent amino acids, constitute the immunoglobulin domains. At the amino-terminal portion (also called the "$NH_2$-terminus" or the "N-terminus"), each light chain and each heavy chain has a single variable region that shows considerable variation in amino acid composition from one antibody to another. The light chain variable region, $V_L$, associates with the variable region of a heavy chain, $V_H$, to form the antigen binding site of the immunoglobulin, called the Fv.

In addition to variable regions, each of the antibody chains has one or more constant regions. Light chains have a single constant region domain. Thus, light chains have one variable region and one constant region. Heavy chains have several constant region domains. The heavy chains in IgG, IgA, and IgD antibodies have three constant region domains, which are designated $CH_1$, $CH_2$, and $CH_3$, and the heavy chains in IgM and IgE antibodies have four constant region domains, CH1, CH2, CH3 and CH4. Thus, heavy chains have one variable region and three or four constant regions. Immunoglobulin structure and function are reviewed, for example, in Harlow et al., Eds., *Antibodies: A Laboratory Manual*, Chapter 14, Cold Spring Harbor Laboratory, Cold Spring Harbor (1988).

The heavy chains of immunoglobulins can also be divided into three functional regions: the Fd region (a fragment comprising $V_H$ and CH1, i.e., the two N-terminal domains of the heavy chain), the hinge region, and the Fc region (the "fragment crystallizable" region, derived from constant regions and formed after pepsin digestion). The Fd region in combination with the light chain forms an Fab (the "fragment antigen-binding"). Because an antigen will react stereochemically with the antigen-binding region at the amino terminus of each Fab the IgG molecule is divalent, i.e., it can bind to two antigen molecules. The Fc contains the domains that interact with immunoglobulin receptors on cells and with the initial elements of the complement cascade. Thus, the Fc fragment is generally considered responsible for the effector functions of an immunoglobulin, such as complement fixation and binding to Fc receptors. Pepsin sometimes also cleaves before the third constant domain (CH3) of the heavy chain to give a large fragment F(abc) and a small fragment pFcb. These terms are also used for analogous regions of the other immunoglobulins. The hinge region, found in IgG, IgA, and IgD class antibodies, acts as a flexible spacer, allowing the Fab portion to move freely in space. In contrast to the constant regions, the hinge domains are structurally diverse, varying in both sequence and length among immunoglobulin classes and subclasses.

For example, the length and flexibility of the hinge region varies among the IgG subclasses. The hinge region of IgG1 reportedly encompasses amino acids 216-231 and because it is freely flexible, the Fab fragments can rotate about their axes of symmetry and move within a sphere centered at the first of two inter-heavy chain disulfide bridges. IgG2 has a shorter hinge than IgG1, reportedly 12 amino acid residues and four disulfide bridges. The hinge region of IgG2 lacks a glycine residue, it is relatively short and contains a rigid poly-proline double helix, stabilised by extra inter-heavy chain disulfide bridges. These properties restrict the flexibility of the IgG2 molecule. IgG3 differs from the other subclasses by its unique extended hinge region (about four times as long as the IgG1 hinge), and is reported to contain 62 amino acids (including 21 prolines and 11 cysteines), forming an inflexible polyproline double helix. In IgG3 the Fab fragments are relatively far away from the Fc fragment, giving the molecule a greater flexibility. The elongated hinge in IgG3 is also responsible for its higher molecular weight compared to the other subclasses. The hinge region of IgG4 is shorter than that of IgG1 and its flexibility is intermediate between that of IgG1 and IgG2. The flexibility of the hinge region reportedly decreases in the order IgG3>IgG1>IgG4>IgG2. The four IgG subclasses also differ from each other with respect to their effector functions. This difference is related to differences in structure, including with respect to the interaction between the variable region, Fab fragments, and the constant Fc fragment. Nevertheless, aside from glycosylation within the CH2 region, for example, and in spite of this knowledge there are no set rules or conventions regarding means or methods to change features, including sequences, of these subclasses of molecule to change, control, add, or remove different functions, for example, ADCC, CDC, and other functions.

According to crystallographic studies, the immunoglobulin hinge region can be further subdivided functionally into three regions: the upper hinge region, the core region, and the lower hinge region. Shin et al., 1992 *Immunological Reviews*

130:87. The upper hinge region includes amino acids from the carboxyl end of CH1 to the first residue in the hinge that restricts motion, generally the first cysteine residue that forms an interchain disulfide bond between the two heavy chains. The length of the upper hinge region correlates with the segmental flexibility of the antibody. The core hinge region contains the inter-heavy chain disulfide bridges, and the lower hinge region joins the amino terminal end of the CH2 domain and includes residues in CH2. Id. The core hinge region of human IgG1 contains the sequence Cys-Pro-Pro-Cys (SEQ ID NO:515) which, when dimerized by disulfide bond formation, results in a cyclic octapeptide believed to act as a pivot, thus conferring flexibility. The hinge region may also contain one or more glycosylation sites, which include a number of structurally distinct types of sites for carbohydrate attachment. For example, IgA1 contains five glycosylation sites within a 17 amino acid segment of the hinge region, conferring resistance of the hinge region polypeptide to intestinal proteases, considered an advantageous property for a secretory immunoglobulin.

Conformational changes permitted by the structure and flexibility of the immunoglobulin hinge region polypeptide sequence may also affect the effector functions of the Fc portion of the antibody. Three general categories of effector functions associated with the Fc region include (1) activation of the classical complement cascade, (2) interaction with effector cells, and (3) compartmentalization of immunoglobulins. The different human IgG subclasses vary in the relative efficacies with which they fix complement, or activate and amplify the steps of the complement cascade. See, e.g., Kirschfink, 2001 *Immunol. Rev.* 180:177; Chakraborti et al., 2000 *Cell Signal* 12:607; Kohl et al., 1999 *Mol. Immunol.* 36:893; Marsh et al., 1999 *Curr. Opin. Nephrol. Hypertens.* 8:557; Speth et al., 1999 *Wien Klin. Wochenschr.* 111:378.

Complement-dependent cytotoxicity (CDC) is believed to be a significant mechanism for clearance of specific target cells such as tumor cells. CDC is a stream of events that consists of a series of enzymes that become activated by each other in a cascade fashion. Complement has an important role in clearing antigen, accomplished by its four major functions: (1) local vasodilation; (2) attraction of immune cells, especially phagocytes (chemotaxis); (3) tagging of foreign organisms for phagocytosis (opsonization); and (4) destruction of invading organisms by the membrane attack complex (MAC attack). The central molecule is the C3 protein. It is an enzyme that is split into two fragments by components of either the classical pathway or the alternative pathway. Antibodies, especially IgG and IgM, induce the classical pathway while the alternative pathway is nonspecifically stimulated by bacterial products like lipopolysaccharide (LPS). Briefly, the products of the C3 split include a small peptide C3a that is chemotactic for phagocytic immune cells and results in local vasodilation by causing the release of C5a fragment from C5. The other part of C3, C3b coats antigens on the surface of foreign organisms and acts to opsonize the organism for destruction. C3b also reacts with other components of the complement system to form an MAC consisting of C5b, C6, C7, C8 and C9.

In general, IgG1 and IgG3 most effectively fix complement, IgG2 is less effective, and IgG4 does not activate complement. Complement activation is initiated by binding of C1q, a subunit of the first component C1 in the cascade, to an antigen-antibody complex. Even though the binding site for C1q is located in the CH2 domain of the antibody, the hinge region influences the ability of the antibody to activate the cascade. For example, recombinant immunoglobulins lacking a hinge region are reportedly unable to activate complement. Shin et al., 1992. Without the flexibility conferred by the hinge region, the Fab portion of the antibody bound to the antigen may not be able to adopt the conformation required to permit C1q to bind to CH2. See id. Hinge length and segmental flexibility have been reported to correlate with complement activation; however, the correlation is not absolute. Human IgG3 molecules with altered hinge regions that are as rigid as IgG4, for example, can still effectively activate the cascade.

The absence of a hinge region, or a lack of a functional hinge region, can also affect the ability of certain human IgG immunoglobulins to bind Fc receptors on immune effector cells. Binding of an immunoglobulin to an Fc receptor facilitates antibody-dependent cell-mediated cytotoxicity, which as noted above is presumed to be an important mechanism for the elimination of tumor cells. The human IgG Fc receptor (FcR) family is divided into three groups, FcγRI (CD64), which is capable of binding IgG with high affinity, and FcγRII (CD32) and FcγRIII (CD16), both of which are lower affinity receptors. The molecular interaction between each of the three receptors and an immunoglobulin has not been defined precisely, but experimental evidence indicates that residues in the hinge proximal region of the CH2 domain may be important to the specificity of the interaction between the antibody and the Fc receptor. IgG1 myeloma proteins and recombinant IgG3 chimeric antibodies that lack a hinge region are reportedly unable to bind FcγRI, perhaps because accessibility to CH2 is decreased. Shin et al., 1993 *Intern. Rev. Immunol.* 10:177, 178-79.

Unusual and apparently evolutionarily unrelated exceptions to the $H_2L_2$ structure of conventional antibodies occur in some isotypes of the immunoglobulins found in camelids (camels, dromedaries and llamas; Hamers-Casterman et al., 1993 *Nature* 363:446; Nguyen et al., 1998 *J. Mol. Biol.* 275:413), nurse sharks (Roux et al., 1998 *Proc. Nat. Acad. Sci. USA* 95:11804), and in the spotted ratfish (Nguyen, et al., "Heavy-chain antibodies in Camelidae; a case of evolutionary innovation," 2002 *Immunogenetics* 54(1):39-47). These antibodies can apparently form antigen-binding regions using only heavy chain variable region, i.e., these functional antibodies are homodimers of heavy chains only (referred to as "heavy-chain antibodies" or "HCAbs"). In both species, these variable regions often contain an extended third complementarity determining region (CDR3) that may help compensate for the lack of a light chain variable region, and there are frequent disulfide bonds between CDR regions that presumably help to stabilize the binding site. Muyldermans et al., 1994 *Prot. Engineer.* 7:1129; Roux et al., 1998. However, the precise function of the heavy chain-only "antibodies" is unknown, and the evolutionary pressure leading to their formation has not been identified. See, e.g., Nguyen, et al., 2002, supra. Camelids, including camels, llamas, and alpacas, also express conventional $H_2L_2$ antibodies, and the heavy chain-only antibodies thus do not appear to be present in these animals simply as an alternative antibody structure.

Variable regions ($V_HH$) of the camelid heavy chain-only immunoglobulins and conventional ($H_2L_2$) heavy chain variable regions contain amino acid differences, including differences at several positions that may be involved in the interface between conventional $V_H$ and $V_L$ domains. Nguyen et al., 1998 *J. Mol. Biol.* 275:413; Muyldermans et al., 1994 *Prot. Engineer.* 7:1129. Camelid $V_HH$ reportedly recombines with IgG2 and IgG3 constant regions that contain hinge, CH2, and CH3 domains and lack a CH1 domain. Hamers-Casterman et al., 1993 *Nature* 363:446. Interestingly, $V_HH$ are encoded by a chromosomal locus distinct from the $V_H$ locus (Nguyen et al., 1998, supra), indicating that camelid B cells have evolved complex mechanisms of antigen recognition and differentiation. Thus, for example, llama IgG1 is a conventional ($H_2L_2$) antibody isotype in which $V_H$ recombines with a constant region that contains hinge, CH1, CH2 and CH3 domains, whereas the llama IgG2 and IgG3 are heavy chain-only isotypes that lack CH1 domains and that contain no light chains.

The classes of immunoglobulins have different physical and chemical characteristics and they exhibit unique biological properties. Their synthesis occurs at different stages and rates during an immune response and/or during the course of an infection. Their importance and functions in host resistance (immunity) are different.

Immunoglobulin G (IgG), a protein with a molecular weight of about 150,000 daltons (150 kD), is the predominant Ig in the serum. It makes up about 80% of the total antibody found in an animal at any given time, being 75% of the total serum antibody. It can diffuse out of the blood stream into the extravascular spaces and it is the most common Ig found there. Its concentration in tissue fluids is increased during inflammation, and it is particularly effective at the neutralization of bacterial extracellular toxins and viruses. It also has opsonizing ability and complement-fixing ability. The polypeptide composition of the Fc region of all IgG1 antibody molecules is relatively constant regardless of antibody specificity; however, as noted above, the Fab regions always differ in their exact amino acid sequences depending upon their antigenic specificity. Specific amino acid regions of the Fc portion of the molecule are recognized by receptors on phagocytes and certain other cells, and the Fc domain contains a peptide region that will bind to and activate complement, which is often required for the manifestation of antibody-mediated immunity. Because the IgG molecule is divalent, it can cross-link antigen molecules, which may lead to precipitation or agglutination of antigens; if IgG is bound to antigen on a microbial cell or surface, its Fc region may provide an extrinsic ligand that will be recognized by specific receptors on phagocytes. Microbial cells or viruses coated with IgG molecules are opsonized for phagocytosis, and opsonized pathogens are taken up and destroyed much more readily by phagocytes than their non-opsonized counterparts. IgG, as well as IgM and IgA, will neutralize the activity of toxins, including bacterial exotoxins. Furthermore, cross-linked IgG molecules on the surface of a cell can bind and activate complement from the serum and set off a cascade of reactions that can lead to destruction of the cell.

IgM is the first immunoglobulin to appear in the blood stream during the course of an infection. It is mainly confined to the bloodstream and provides protection against blood-borne pathogens. IgM makes up about 10% serum immunoglobulins, and is arranged to resemble a pentamer of five immunoglobulin molecules (having a molecular weight of about 900 kD) tethered together at by their Fc domains. In addition to covalent linkages between the monomeric subunits, the pentamer is stabilized by a 15 kd polypeptide called J chain. IgM, therefore, has a theoretical "valence" of ten (i.e., it has ten exposed Fab domains). Probably, the most important role of IgM is its ability to function early in the immune responses against blood-borne pathogens given its efficiency in agglutinating particulate antigens. IgM binds also complement strongly and IgM antibodies bound to a microbial surface act as opsonins, rendering the microbe more susceptible to phagocytosis. In the presence of complement and IgM whole microbial cells may be killed and lysed. As noted above, IgM also appears on the surfaces of mature B cells as a transmembranous monomer where it functions as an antigen receptor, capable of activating B cells when bound to antigen.

Gene rearrangement at the immunoglobulin loci during lymphoid development generates a repertoire of B lymphocytes that express a diversity of antigen receptors. The gene rearrangement, which is catalysed by the rearrangement-activating gene ("RAG") recombinase, integrates the immunoglobulin V, D and J gene segments to yield productively rearranged immunoglobulin genes that encode the heavy and light chains of IgM antibodies. The diversity of IgM antibodies in this primary repertoire is achieved through combinatorial mechanisms (the choice of V, D and J gene segments utilized in a particular antibody), as well as junctional diversity. The joining of V, D and J gene segments is somewhat imprecise, and nucleotides may be inserted at the junction in a non-templated manner. There is therefore a very high degree of resultant diversity at the V-D-J borders. This contributes in a major way to the structural diversity of the third complementarity determining region of the antibody, a region that often plays a critical role in antigen recognition. This primary repertoire of IgM antibodies comprises a few million different structures. The size of this repertoire means that any incoming antigen is likely to encounter an antibody that recognizes it with acceptable affinity. A high-affinity binding site is unlikely to be available for most incoming antigens (the repertoire is not large enough), but the affinity of the available IgM antibodies in the primary repertoire will vary from antigen to antigen. If an epitope is re-iterated at high density on the surface of the antigen (e.g., a repeated structure on the surface of a virus or bacterium), then an IgM antibody may nevertheless be effective in mediating clearance of the organism, despite the low affinity of the individual interaction between antigenic epitope and immunoglobulin combining site. The density of the epitopes may allow multivalent interactions with IgM, leading to a high-avidity interaction, providing that a suitable spacing of antigenic epitopes can occur. Nevertheless, to ensure an effective and specific response, especially when the concentration of antigen is low (as may occur when the body is faced with a very small number of infecting viral particles), it would be preferable if high-affinity antibodies were available for neutralizing, for example, an infecting organism. The size of the primary repertoire militates against the likelihood of such high-affinity antibodies being present in this repertoire. The immune system therefore operates using a two-stage strategy. The primary repertoire of IgM antibodies is generated by a process of gene rearrangement and takes place prior to antigen encounter during early lymphocyte development. However, once foreign antigen has been encountered, those B cells in the primary repertoire that encode suitable (albeit low-affinity) antibodies are selectively expanded and subjected to an iterative alternation of directed hypermutation and antigen-mediated selection. This allows a significant maturation in affinity of the antigen-specific antibodies that are produced. Antigen triggering also drives isotype switch recombination. Thus, in the absence of external antigen stimulation and any maternally derived immunoglobulin, the serum will only contain a diversity of unmutated IgM molecules that have been generated by gene rearrangement. This repertoire shifts with age as a result of continuous antigen exposure, such that the majority of the serum immunoglobulin in older animals is composed of mutated IgG (and IgA) molecules whose specificities have developed as a consequence of antigen selection.

IgA exists as a $H_2L_2$ monomer of about 160 kD in serum and, in secretions, as a dimer of the $H_2L_2$ monomer of about 400 kD. As with IgM, polymerization (dimerization) is via a J-chain. IgA has two subclasses based on different heavy chains, IgA1 and IgA2. IgA1 is produced in bone marrow and makes up most of the serum IgA. Both IgA1 and IgA2 are synthesized in GALT (gut associated lymphoid tissues) to be secreted onto the mucosal surfaces. Because IgA may be synthesized locally and secreted in the seromucous secretions of the body, it is sometimes referred to as secretory antibody or sIgA. Quantitatively, IgA is synthesized in amounts greater than IgG, but it has a short half life in serum (6 days), and it is lost in secretory products. The concentration of IgA in serum is about 15% of the total antibody. Secretion of dimeric IgA is mediated by a 100 kD glycoprotein called secretory component. It is the addition of the secretory piece to IgA molecules that accounts for their ability to exit the body to mucosal surfaces via the exocrine glands. IgM can be transported similarly and makes up a small proportion of secretory antibodies. Secretory IgA is the predominant immunoglobulin present in gastrointestinal fluids, nasal secretions, saliva, tears and other mucous secretions of the body. IgA antibodies are important in resistance to infection of the mucosal surfaces of the body, particularly the respiratory, intestinal and urogenital tracts. IgA acts as a protective coating for the mucous surfaces against microbial adherence or initial colonization. It can also neutralize toxin activity on mucosal surfaces. Fc receptors for IgA-coated microorganisms found on monocytes and neutrophils derived from the respiratory mucosa suggest that IgA may have a role in the lung, at least, in opsonization of pathogens. Secretory IgA is also transferred via the milk, i.e., the colostrum, from a nursing mother to a newborn, which provides passive immunity to many pathogens, especially those that enter by way of the GI tract.

IgE is an immunoglobulin of about 190 kD that accounts for about 0.002% of the total serum immunoglobulins. It is produced by plasma cells below the respiratory and intestinal epithelia. The majority of IgE is bound to tissue cells, especially mast cells. If an infectious agent succeeds in penetrating the IgA barrier, it comes up against the next line of defense, the MALT (mucosa-associated lymphoid tissues) system that is managed by IgE. IgE is bound very firmly to specific IgE Fc receptors on mast cells. Contact with antigen leads to release of mediators of inflammation from the mast cells, which effectively recruits various agents of the immune response including complement, chemotactic factors for phagocytes, T cells, etc. Although a well-known manifestation of this reaction is a type of immediate hypersensitivity reaction called atopic allergy (e.g., hives, asthma, hay fever, etc.), the MALT responses act as a defense mechanism because they amplify the inflammatory response and may facilitate rejection of a pathogen.

IgD is a molecule of about 175 kd that resembles IgG in its monomeric form. IgD antibodies are found for the most part on the surfaces of B lymphocytes. The same cells may also carry IgM antibody. As noted above, it is thought that IgD and IgM function as mutually interacting antigen receptors for control of B cell activation and suppression. Hence, IgD may have an immunoregulatory function.

In addition to opsonization, activation of complement, and ADCC, antibodies have other functions in host defense including steric hindrance, toxin neutralization, agglutination, and precipitation. With regard to steric hindrance, it is understood that antibodies combine with the surfaces of microorganisms and may block or prevent their attachment to susceptible cells or mucosal surfaces. Antibody against a viral component can block attachment of the virus to susceptible host cells and thereby reduce infectivity. Secretory IgA can block attachment of pathogens to mucosal surfaces. Toxin-neutralizing antibodies (antitoxins) can also react with a soluble bacterial toxin and block the interaction of the toxin with its specific target cell or substrate. Antibodies can also combine with the surfaces of microorganisms or soluble antigens and cause them to agglutinate or precipitate. This reduces the number of separate infectious units and makes them more readily phagocytosed because the clump of particles is larger in size. Phagocytes may remove floccules or aggregates of neutralized toxin.

Antibodies have been proposed for use in therapy. Animals, including humans and mice have the ability to make antibodies able to recognize (by binding to) virtually any antigenic determinant and to discriminate between similar epitopes. Not only does this provide the basis for protection against disease organisms, but it also makes antibodies attractive candidates to target other types of molecules found in the body, such as receptors or other proteins present on the surface of normal cells and molecules present uniquely on the surface of cancer cells. Thus the remarkable specificity of antibodies makes them promising agents for human therapy.

Initial antibody preparations available for use, such as intravenous gammaglobulins, included animal and human antisera that were used in vivo to destroy bacteria (tetanus, pneumococcus) and neutralize virus (hepatitis A and B, rabies, cytomegalovirus, and varicella zoster) in the blood of infected individuals. Possibly the most important early application was the use of endotoxins. However, there are problems associated with the use of antibodies in human therapy because the response of the immune system to any antigen, even the simplest, is "polyclonal," i.e., the system manufactures antibodies of a great range of structures both in their binding regions as well as in their effector regions. Polyclonal antibody treatment was also associated with unwanted side effects. In addition to the polyclonal nature of these antibody preparations, there was the risk of infection from contaminating viruses. Serum sickness and anaphylaxis were also considered limiting factors. Furthermore, even if one were to isolate a single antibody-secreting cell, and place it in culture, it would die out after a few generations because of the limited growth potential of all normal somatic cells.

Until the late 1970s, polyclonal antibodies obtained from the blood serum of immunized animals provided the only source of antibodies for research or treatment of disease. Isolation of specific antibodies was essentially impossible until Kohler and Milstein discovered how to make "monoclonal antibodies" that would have a single specificity, that would all be alike due to manufacture by a single clone of plasma cells and that could be grown indefinitely. This technique was described in a 1975 publication (*Nature* 256:495-97), and Köhler and Milstein received the 1984 Nobel Prize in Medicine for their work.

The first step in Kohler and Milstein's technique for production of monoclonal antibodies involves immunizing an experimental animal with the antigen of interest. In most of their experiments, Kohler and Milstein injected a mouse with sheep red blood cells. The mouse's body initiates an immune response and begins producing antibodies specific to the antigen. The mouse's spleen is then removed and B cells producing the antibody of interest are isolated. Tumor-producing cells that have been grown in culture are then fused with the B lymphocytes using polyethylene glycol in order to produce a "hybridoma." Only hybridomas resulting from the fusion will survive. The spleen lymphocyte has a limited life span, so any B cells that did not fuse with a myeloma will die in the culture. Additionally, those cells that lack the antibody-producing aspect of the B cell will not secrete the enzyme HGPRT, which is required for growth in the hypoxathine-aminopterinthymidine (HAT) medium. The HAT medium, on which the cells are grown, inhibits the pathway for nucleotide synthesis. Cells that produce HGPRT can bypass this pathway and continue to grow. By placing the fused cells in a HAT medium, true hybridomas can be isolated. The isolated hybridoma cells are then screened for specificity to the desired antigen. Because each hybridoma descends from one B cell, it makes copies of only one antibody. The hybridoma that produces the antibody of interest is grown in culture to produce large amounts of monoclonal antibodies, which are then isolated for further use. The technique is called somatic cell hybridization, and the resulting hybridoma (selected for both immortality and production of the specific antibody of interest) may be cultured indefinitely, i.e., it is a potenially immortal cell line.

Monoclonal antibodies are now widely used as diagnostic and research reagents. However, their introduction into human therapy has been much slower. One principal difficulty is that mouse antibodies are "seen" by the human immune system as foreign. The human patient mounts an immune response against them, producing HAMA ("human anti-mouse antibodies"). These not only cause the therapeutic antibodies to be quickly eliminated from the host, but also form immune complexes that cause damage to the kidneys.

Two approaches have been used in an attempt to reduce the problem of HAMA. The first is the production of chimeric antibodies in which the antigen-binding part (variable regions) of a mouse monoclonal antibody is fused to the effector part (constant region) of a human antibody using genetic engineering. In a second approach, rodent antibodies have been altered through a technique known as complementarity determining region (CDR) grafting or "humanization." In this process, the antigen binding sites, which are formed by three CDRs of the heavy chain and three CDRs of the light chain, are excised from cells secreting rodent mAb and grafted into the DNA coding for the framework of the human antibody. Because only the antigen-binding site CDRs, rather than the entire variable domain of the rodent antibody are transplanted, the resulting humanized antibody (a second generation or "hyperchimeric" antibody) is reportedly less immunogenic than a first generation chimeric antibody. This process has been further improved to include changes referred to as "reshaping" (Verhoeyen, et al., "Reshaping human antibodies: grafting an anti-lysozyme activity," 1988 *Science* 239:1534-1536; Riechmann, et al., "Reshaping human antibodies for therapy," 1988 *Nature* 332:323-337; Tempest, et al., "Reshaping human monoclonal antibody to inhibit respiratory syncitial virus infection in vivo," *Bio/Technol* 1991 9:266-271), "hyperchimerization" (Queen, et al., "A humanized antibody that binds to the human interleukin 2 receptor," 1989 *Proc Natl Acad Sci USA* 86:10029-10033; Co, et al., "Humanized antibodies for antiviral therapy," 1991 *Proc Natl Acad Sci USA* 88:2869±2873; Co, et al., "Chimeric and humanized antibodies with specificity for the CD33 antigen," 1992 *J Immunol* 148:1149-1154), and "veneering" (Mark, et al., "Derivation of therapeutically active humanized and veneered anti-CD18 antibodies. In: Metcalf B W, Dalton B J, eds. Cellular adhesion: molecular definition to therapeutic potential. New York: Plenum Press, 1994:291-312).

In the reshaping process on the basis of homology, the rodent variable region is compared with the consensus sequence of the protein sequence subgroup to which it belongs. Similarly, the selected human constant region accepting framework is compared with its family consensus sequence. Gussowal, et al., "Humanization of monoclonal antibodies," 1991 *Meth Enzymol* 203:99-121. The sequence analyses identify residues, which may have undergone mutation during the affinity maturation procedure and may therefore be idiosyncratic. Inclusion of the more common human residues is said to lessen immunogenicity problems by replacing human acceptor idiosyncratic residues. Further, the reshaping process is said to allow comparison of human and rodent consensus sequences to identify any systematic "species" differences. RSV19 antibodies were humanized by employing this procedure. Taylor et al., "Humanized monoclonal antibody to respiratory syncitial virus," 1991 *Lancet* 337:1411-1412; Tempest, et al., "Reshaping a human monoclonal antibody to inhibit human respiratory syncitial virus infection in vivo," 1991 *Bio/Technol* 9:266-271.

Hyperchimerization is an alternative method of identifying residues outside CDR regions that are likely to be involved in the reconstitution of binding activity. In this method, the human sequences are compared with murine variable region sequences and the one with highest homology is selected as the acceptor framework. As in the reshaping procedure, the "idiosyncratic" residues are replaced by more commonly occurring human residues. The non-CDR residues that may be interacting with the CDR sequences are identified. Finally, it is determined which one of these residues is to be included in the variable region framework. Humanized antibodies against CD33 antigen were reportedly developed by this method. Co, et al., "Chimeric and humanized antibodies with specificity for the CD33 antigen," 1992 *J Immunol* 148:1149-154. See also Carter, et al., "Humanization of an anti-p185 HER2 antibody for human cancer therapy," 1992 *Proc Natl Acad Sci USA* 89:4285-4289.

The displayed surface of the protein is the primary determinant of its immunogenicity. A humanized murine antibody can thus be made less immunogenic by replacing exposed residues that differ from those commonly found in human antibodies. This method of humanization is referred to as "veneering." Appropriate replacement of the outer residues may have little or no impact on the inner domains or interdomain framework. Veneering is a two-step process. In the first step, the most homologous human variable regions are selected and compared by each single residue to the corresponding mouse variable regions. In the second step, the residues present in the human homologue replace the mouse framework residues, which differ from its human homologue. This replacement involves only those residues that are on the surface and at least partially exposed.

Nevertheless, it took more than a quarter century of research for monoclonal antibody technology and genetic engineering methods to result in the development of immunoglobulin molecules for treatment of human diseases. Indeed, it was not until the past five years that monoclonal antibodies became an expanding class of therapeutics. See Glennie M J and van de Winkel J G, *Drug Discov Today* 2003 Jun. 1; 8(11):503-10; Souriau C and Hudson P J, "Recombinant antibodies for cancer diagnosis and therapy," 2003 *Expert Opin Biol Ther.* 3(2):305-18. See also Pendley C, et al., "Immunogenicity of therapeutic monoclonal antibodies," 2003 *Curr Opin Mol. Ther.* 5(2):172-9.

All the same, an average of less than one therapeutic antibody per year has been introduced to the market beginning in 1986, eleven years after the publication of monoclonal antibodies. Five murine monoclonal antibodies were introduced into human medicine over a ten year period from 1986-1995, including "muromonab-CD3" (OrthoClone OKT3®), which binds to a molecule on the surface of T cells and was launched in 1986 to prevent acute rejection of organ transplants; "edrecolomab" (Panorex®), launched in 1995 for treatment of colorectal cancer; "odulimomab" (Antilfa®), launched in 1997 for use in transplant rejection; and, "ibritumomab" (Zevalin® yiuxetan), launched in 2002 for use in non-Hodgkin's lymphoma. Additionally, one monoclonal Fab, "abciximab" (ReoPro®), was launched in 1995. It inhibits the clumping of platelets by binding the receptors on their surface that normally are linked by fibrinogen and may be helpful in preventing reclogging of the coronary arteries in patients who have undergone angioplasty. Three chimeric monoclonal antibodies were also launched: "rituximab" (Rituxan®), in 1997, which binds to the CD20 molecule found on most B cells and is used to treat B cell lymphomas; "basiliximab" (Simulect®), in 1998 for transplant rejection; and "infliximab" (Remicade®) which binds to tumor necrosis factor-alpha (TNF-a), in 1998 for treatment of rheumatoid arthritis and Crohn's disease. Additionally, "abciximab" (ReoPro®), a 47.6 kD Fab fragment of the chimeric human-murine monoclonal antibody 7E3 that binds to the glycoprotein (GP) IIb/IIIa receptor of human platelets, was launched in 1995 as an adjunct to percutaneous coronary intervention for the prevention of cardiac ischemic complications in patients undergoing percutaneous coronary intervention. Finally, seven "humanized" monoclonals were launched from 1997-2003: "daclizumab" (Zenapax®) in 1997, which binds to part of the IL-2 receptor produced at the surface of activated T cells and is used to prevent acute rejection of transplanted kidneys; "palivizumab" (Synagis®) in 1998 for RSV; "trastuzumab" (Herceptin®) in 1998, which binds HER-2, a growth factor receptor found on breast cancers cells; "gemtuzumab" (Mylotarg®) in 2000, which is a conjugate of a monoclonal antibody that binds CD33, a cell-surface molecule expressed by the cancerous cells in acute myelogenous leukemia (AML) but not found on the normal stem cells needed to repopulate the bone marrow; and "alemtuzumab" (MabCampath®) in 2001, which binds to CD52, a molecule found on white blood cells and has produced temporary remission of chronic lymphocytic leukemia; "adalimumab" (Humira® (D2E7)), a human anti-TNF monoclonal containing human-derived heavy chain and light chain variable regions and human IgG:κ constant regions was launched in 2002 for the treatment of rheumatoid arthritis; and, "omalizumab" (Xolair®), which binds to IgE and prevents it from binding to mast cells was approved in 2003 for the treatment of adults and adolescents over 12 years of age with moderate to severe persistent asthma who have a positive skin test or in vitro reactivity to a perennial aeroallergen and whose symptoms are inadequately controlled with inhaled corticosteroids.

Thus, protein engineering has been applied in an effort to diminish problems related to immunogenicity of administered recombinant immunoglobulin polypeptides and to try to alter antibody effector functions. However, problems remain. For example, the majority of cancer patients treated with rituximab relapse, generally within about 6-12 months, and fatal infusion reactions within 24 hours of rituximab infusion have been reported. These fatal reactions followed an infusion reaction complex that included hypoxia, pulmonary infiltrates, acute respiratory distress syndrome, myocardial infarction, ventricular fibrillation or cardiogenic shock. Acute renal failure requiring dialysis with instances of fatal outcome has also been reported in the setting of tumor lysis syndrome following treatment with rituximab, as have severe mucocutaneous reactions, some with fatal outcome. Additionally, high doses of rituximab are required for intravenous injection because the molecule is large, approximately 150 kDa, and diffusion is limited into the lymphoid tissues where many tumor cells reside.

Trastuzumab administration can result in the development of ventricular dysfunction and congestive heart failure, and the incidence and severity of cardiac dysfunction has been reported to be particularly high in patients who received trastuzumab in combination with anthracyclines and cyclophosphamide. Trastuzumab administration can also result in severe hypersensitivity reactions (including anaphylaxis), infusion reactions, and pulmonary events.

Patients receiving daclizumab immunosuppressive therapy are at increased risk for developing lymphoproliferative disorders and opportunistic infections, and it is not known whether daclizumab use will have a long-term effect on the ability of the immune system to respond to antigens first encountered during daclizumab-induced immunosuppression.

Hepatotoxicity, including severe hepatic veno-occlusive disease (VOD), has also been reported in association with the use of gemtuzumab as a single agent, as part of a combination chemotherapy regimen, and in patients without a history of liver disease or hematopoietic stem-cell transplant (HSCT). Patients who receive gemtuzumab either before or after HSCT, patients with underlying hepatic disease or abnormal liver function, and patients receiving gemtuzumab in combinations with other chemotherapy may be at increased risk for developing severe VOD. Death from liver failure and from VOD has been reported in patients who received gemtuzumab, and it has been cautioned that even careful monitoring may not identify all patients at risk or prevent the complications of hepatotoxicity.

Hepatotoxicity was also reported in patients receiving alemtuzumab. Serious and, in some rare instances fatal, pancytopenia/marrow hypoplasia, autoimmune idiopathic thrombocytopenia, and autoimmune hemolytic anemia have occurred in patients receiving alemtuzumab therapy. Alemtuzumab can also result in serious infusion reactions as well as opportunistic infections.

In patients treated with adalimumab, serious infections and sepsis, including fatalities, have been reported, as has the exacerbation of clinical symptoms and/or radiographic evidence of demyelinating disease, and patients treated with adalimumab in clinical trials had a higher incidence of lymphoma than the expected rate in the general population.

Serious adverse reactions in clinical studies with omalizumab have included malignancies and anaphylaxis, in which the observed incidence of malignancy among omalizumab-treated patients (0.5%) was numerically higher than among patients in control groups (0.2%).

Smaller immunoglobulin molecules have been constructed in an effort to overcome various problems associated with whole immunoglobulin therapy. Single chain immunoglobulin variable region fragment polypeptides (scFvs) are made of an immunoglobulin heavy chain variable domain joined via a short linker peptide to an immunoglobulin light chain variable domain. Huston et al., 1988 *Proc. Natl. Acad. Sci. USA*, 85:5879-83. It has been suggested that the smaller size of scFv molecules may lead to more rapid clearance from plasma and more effective penetration into tissues than whole immunoglobulins. See, e.g., Jain, 1990 Cancer Res. 50:814s-819s. An anti-tumor scFv was reported to show more rapid tumor penetration and more even distribution through the tumor mass than the corresponding chimeric antibody. Yokota et al., *Cancer Res.* 52:3402-08 (1992).

Despite advantages that scFv molecules may have with regard to serotherapy, drawbacks to this therapeutic approach also exist. For example, rapid clearance of scFv may prevent delivery of a minimum effective dose to the target tissue. Additionally, manufacturing adequate amounts of scFv for administration to patients has been challenging due to difficulties in expression and isolation of scFv that adversely affect yields. During expression, scFv molecules lack stability and often aggregate due to pairing of variable regions from different molecules. Furthermore, production levels of scFv molecules in mammalian expression systems are reportedly low, which may limit the potential for efficient manufacturing of scFv molecules for therapy. Davis et al., 1990 *J. Biol. Chem.* 265:10410-18; Traunecker et al., 1991 *EMBO J.* 10:3655-59. Strategies for means to improve production have been explored, and reportedly include the addition of glycosylation sites to variable regions. See, e.g., U.S. Pat. No. 5,888,773; Jost et al., 1994 *J. Biol. Chem.* 269:26267-73. Another disadvantage to the use of scFvs for therapy is the lack of effector function. An scFv that lacks the cytolytic functions, ADCC, and complement dependent-cytotoxicity may be less effective or ineffective for treating disease. Even though development of scFv technology began over 12 years ago, there are currently no scFv products approved for therapy.

Alternatively, it has been proposed that fusion of an scFv to another molecule, such as a toxin, could take advantage of the specific antigen-binding activity and the small size of an scFv to deliver the toxin to a target tissue. Chaudary et al., 1989 *Nature* 339:394; Batra et al., 1991 *Mol. Cell. Biol.* 11:2200. Conjugation or fusion of toxins to scFvs has thus been offered as an alternative strategy to provide potent, antigen-specific molecules, but dosing with such conjugates or chimeras can be limited by excessive and/or non-specific toxicity due to the toxin moiety of such preparations. Toxic effects may include supraphysiological elevation of liver enzymes and vascular leak syndrome, and other undesired effects. In addition, immunotoxins are themselves highly immunogenic upon administration to a host, and host antibodies generated against the immunotoxin limit potential usefulness for repeated therapeutic treatments of an individual.

Fusion proteins in which immunoglobulin constant region polypeptide sequences are present and nonimmunoglobulin sequences are substituted for the antibody variable regions have also been investigated. For example, CD4, the T cell surface protein recognized by HIV, was recombinantly fused to an immunoglobulin Fc effector domain, and an IL-2-IgG1 fusion protein reportedly effected complement-mediated lysis of IL-2 receptor-bearing cells. See Sensel et al., *Chem. Immunol.* 65:129-158 (1997). An extensive introduction as well as detailed information about all aspects of recombinant antibody technology can be found in the textbook "Recombinant Antibodies" (John Wiley & Sons, NY, 1999). A comprehensive collection of detailed antibody engineering lab Protocols can be found in R. Kontermann and S. Dübel (eds.), "The Antibody Engineering Lab Manual" (Springer Verlag, Heidelberg/New York, 2000).

Diseases and disorders thought to be amenable to some type of immunoglobulin therapy include cancer and immune system disorders. Cancer includes a broad range of diseases, affecting approximately one in four individuals worldwide. Rapid and unregulated proliferation of malignant cells is a hallmark of many types of cancer, including hematological malignancies. Although patients with a hematologic malignant condition have benefited from advances in cancer therapy in the past two decades, Multani et al., 1998 *J. Clin. Oncology* 16:3691-3710, and remission times have increased, most patients still relapse and succumb to their disease. Barriers to cure with cytotoxic drugs include, for example, tumor cell resistance and the high toxicity of chemotherapy, which prevents optimal dosing in many patients.

Nevertheless, patients have been treated with immunotherapeutics that target malignant cells, i.e., to antigens expressed on tumor cells. With regard to the selection of tumor cell surface antigens suitable for use as immunotherapy targets, it is preferable that such a target antigen is not expressed by normal tissues, particularly where the preservation of such tissue is important to host survival. In the case of hematologic malignancy, malignant cells express many antigens that are not expressed on the surfaces of stem cells or other essential cells. Treatment of a hematologic malignant condition using a therapeutic regimen that depletes both normal and malignant cells of hematological origin has been acceptable where regeneration of normal cells from progenitors can occur after therapy has ended. Additionally, the target antigen is desirably expressed on all or virtually all clonogenic populations of tumor cells, and it is best that expression persists despite selective pressure from immunoglobulin therapy. Strategies that employ selection of a cell surface idiotype (e.g., a particular idiotope) as a target for therapy of B cell malignancy have been limited by the outgrowth of tumor cell variants with altered surface idiotype expression, even where the antigen exhibits a high degree of tumor selectivity. Meeker et al., 1985 *N. Engl. J. Med.* 312:1658-65. The selected antigen should also traffic properly after an immunoglobulin binds to it. Shedding or internalization of a cell surface target antigen after an immunoglobulin binds to the antigen may allow tumor cells to escape destruction, thus limiting the effectiveness of serotherapy. Finally, binding of an immunoglobulin to cell surface target antigens that transmit or transduce cellular activation signals may result in improved functional responses to immunotherapy in tumor cells, and can lead to growth arrest and/or apoptosis. While all of these properties are important, the triggering of apoptosis after an immunoglobulin binds to the target antigen may also be a critical factor in achieving successful serotherapy.

Antigens that have been tested as targets for serotherapy of B and T cell malignancies include Ig idiotype (Brown et al., 1989 *Blood* 73:651-61), CD19 (Hekman et al., 1991 *Cancer Immunol. Immunother.* 32:364-72), Vlasveld et al., 1995 *Cancer Immunol. Immunother.* 40:37-47), CD20 (Press et al., 1987 *Blood* 69: 584-91), Maloney et al., 1997 *J. Clin. Oncol.* 15:3266-74), CD21 (Scheinberg et al., 1990 *J. Clin. Oncol.* 8:792-803), CD5 (Dillman et al., 1986 *J. Biol. Respn. Mod.* 5:394-410), and CD52 (CAMPATH) (Pawson et al., 1997 *J. Clin. Oncol.* 15:2667-72). Of these, greater benefit for therapy of B cell lymphomas has been obtained using molecules that target CD20. Other targets have been limited by biological properties of the antigen. For example, surface idiotype can be altered through somatic mutation, allowing tumor cell escape. CD5, CD21, and CD19 are rapidly internalized after monoclonal antibody binding, allowing tumor cells to escape destruction unless monoclonal antibodies are conjugated with toxin molecules. CD22 is expressed on only a subset of B cell lymphomas, thereby limiting its usefulness, while CD52 is expressed on both T cells and B cells and may therefore generate counterproductive immunosuppression by depletion.

Treatment of patients with low grade or follicular B cell lymphoma using a chimeric CD20 monoclonal antibody has been reported to induce partial or complete responses in patients. McLaughlin et al., 1996 *Blood* 88:90a (abstract, suppl. 1); Maloney et al., 1997 *Blood* 90:2188-95. However, as noted above, tumor relapse commonly occurs within six months to one year. Further improvements in serotherapy are needed to induce more durable responses, for example, in low grade B cell lymphoma, and to allow effective treatment of high-grade lymphoma and other B cell diseases.

Another approach has been to target radioisotopes to B cell lymphomas using monoclonal antibodies specific for CD20. While the effectiveness of therapy is reportedly increased, associated toxicity from the long in vivo half-life of the radioactive antibody increases also, sometimes requiring that the patient undergo stem cell rescue. Press et al., 1993 *N. Eng. J. Med.* 329:1219-1224; Kaminski et al., 1993 *N. Eng. J. Med.*

329:459-65. Monoclonal antibodies to CD20 have also been cleaved with proteases to yield F(ab')$_2$ or Fab fragments prior to attachment of radioisotope. This has been reported to improve penetration of the radioisotope conjugate into the tumor and to shorten the in vivo half-life, thus reducing the toxicity to normal tissues. However, these molecules lack effector functions, including complement fixation and/or ADCC.

CD20 was the first human B cell lineage-specific surface molecule identified by a monoclonal antibody. It is a non-glycosylated, hydrophobic 35 kDa B cell transmembrane phosphoprotein that has both amino and carboxy ends situated in the cytoplasm. Einfeld et al., 1988 *EMBO J.* 7:711-17. CD20 is expressed by all normal mature B cells, but is not expressed by precursor B cells. Natural ligands for CD20 have not been identified, and the function of CD20 in B cell biology is still incompletely understood.

Anti-CD20 monoclonal antibodies affect the viability and growth and growth of B cells. Clark et al., 1986 Proc. Natl. Acad. Sci. USA 83:4494-98. Extensive cross-linking of CD20 can induce apoptosis in B lymphoma cell lines, Shan et al., 1998 *Blood* 91:1644-52, and cross-linking of CD20 on the cell surface has been reported to increase the magnitude and enhance the kinetics of signal transduction, for example, as detected by measuring tyrosine phosphorylation of cellular substrates. Deans et al., 1993 *J. Immunol.* 146:846-53. Therefore, in addition to cellular depletion by complement and ADCC mechanisms, Fc-receptor binding by CD20 monoclonal antibodies in vivo may promote apoptosis of malignant B cells by CD20 cross-linking, consistent with the theory that effectiveness of CD20 therapy of human lymphoma in a SCID mouse model may be dependent upon Fc-receptor binding by the CD20 monoclonal antibody. Funakoshi et al., 1996 *J. Immunotherapy* 19:93-101. The presence of multiple membrane spanning domains in the CD20 polypeptide (Einfeld et al., 1988 *EMBO J.* 7:711-17; Stamenkovic et al., 1988 *J. Exp. Med.* 167:1975-80; Tedder et al., 1988 *J. Immunol.* 141:4388-4394), prevent CD20 internalization after antibody binding, and this was recognized as an important feature for therapy of B cell malignancies when a murine CD20 monoclonal antibody, 1F5, was injected into patients with B cell lymphoma, resulting in significant depletion of malignant cells and partial clinical responses. Press et al., 1987 *Blood* 69:584-91.

Because normal mature B cells also express CD20, normal B cells are depleted by anti-CD20 antibody therapy. Reff, M. E. et al., 1994 *Blood* 83:435-445. After treatment is completed, however, normal B cells can be regenerated from CD20 negative B cell precursors; therefore, patients treated with anti-CD20 therapy do not experience significant immunosuppression. Depletion of normal B cells may also be beneficial in diseases that involve inappropriate production of autoantibodies or other diseases where B cells may play a role. A chimeric monoclonal antibody specific for CD20, consisting of heavy and light chain variable regions of mouse origin fused to human IgG1 heavy chain and human kappa light chain constant regions, reportedly retained binding to CD20 and the ability to mediate ADCC and to fix complement. Liu et al., 1987 *J. Immunol.* 139:3521-26. The mechanism of anti-tumor activity of rituximab, discussed above, is thought to be a combination of several activities, including ADCC, complement fixation, and triggering of signals that promote apoptosis in malignant B cells, although the large size of rituximab prevents optimal diffusion of the molecule into lymphoid tissues that contain malignant B cells, thereby limiting these anti-tumor activities. Autoimmune diseases include autoimmune thyroid diseases, which include Graves' disease and Hashimoto's thyroiditis. In the United States alone, there are about 20 million people who have some form of autoimmune thyroid disease. Autoimmune thyroid disease results from the production of autoantibodies that either stimulate the thyroid to cause hyperthyroidism (Graves' disease) or destroy the thyroid to cause hypothyroidism (Hashimoto's thyroiditis). Stimulation of the thyroid is caused by autoantibodies that bind and activate the thyroid stimulating hormone (TSH) receptor. Destruction of the thyroid is caused by autoantibodies that react with other thyroid antigens. Current therapy for Graves' disease includes surgery, radioactive iodine, or antithyroid drug therapy. Radioactive iodine is widely used, since antithyroid medications have significant side effects and disease recurrence is high. Surgery is reserved for patients with large goiters or where there is a need for very rapid normalization of thyroid function. There are no therapies that target the production of autoantibodies responsible for stimulating the TSH receptor. Current therapy for Hashimoto's thyroiditis is levothyroxine sodium, and therapy is usually lifelong because of the low likelihood of remission. Suppressive therapy has been shown to shrink goiters in Hashimoto's thryoiditis, but no therapies that reduce autoantibody production to target the disease mechanism are known.

Rheumatoid arthritis (RA) is a chronic disease characterized by inflamation of the joints, leading to swelling, pain, and loss of function. RA affects an estimated 2.5 million people in the United States. RA is caused by a combination of events including an initial infection or injury, an abnormal immune response, and genetic factors. While autoreactive T cells and B cells are present in RA, the detection of high levels of antibodies that collect in the joints, called rheumatoid factor, is used in the diagnosis of RA. Current therapy for RA includes many medications for managing pain and slowing the progression of the disease. No therapy has been found that can cure the disease. Medications include nonsteroidal anti-inflamatory drugs (NSAIDS), and disease modifying anti-rheumatic drugs (DMARDS). NSAIDS are useful in benign disease, but fail to prevent the progression to joint destruction and debility in severe RA. Both NSAIDS and DMARDS are associated with signficant side effects. Only one new DMARD, Leflunomide, has been approved in over 10 years. Leflunomide blocks production of autoantibodies, reduces inflammation, and slows progression of RA. However, this drug also causes severe side effects including nausea, diarrhea, hair loss, rash, and liver injury.

Systemic Lupus Erythematosus (SLE) is an autoimmune disease caused by recurrent injuries to blood vessels in multiple organs, including the kidney, skin, and joints. SLE is estimated to affect over 500,000 people in the United States. In patients with SLE, a faulty interaction between T cells and B cells results in the production of autoantibodies that attack the cell nucleus. These include anti-double stranded DNA and anti-Sm antibodies. Autoantibodies that bind phospholipids are also found in about half of SLE patients, and are responsible for blood vessel damage and low blood counts. Immune complexes accumulate the kidneys, blood vessels, and joints of SLE patients, where they cause inflamation and tissue damage. No treatment for SLE has been found to cure the disease. NSAIDS and DMARDS are used for therapy depending upon the severity of the disease. Plasmapheresis with plasma exchange to remove autoantibodies can cause temporary improvement in SLE patients. There is general agreement that autoantibodies are responsible for SLE, so new therapies that deplete the B cell lineage, allowing the immune system to reset as new B cells are generated from precursors, would offer hope for long lasting benefit in SLE patients.

Sjogren's syndrome is an autoimmune disease characterized by destruction of the body's moisture-producing glands. Sjogren's syndrome is one of the most prevelant autoimmune disorders, striking up to an estimated 4 million people in the United States. About half of people stricken with Sjogren's syndrome also have a connective tissue disease, such as RA, while the other half have primary Sjogren's syndrome with no other concurrent autoimmune disease. Autoantibodies, including anti-nuclear antibodies, rheumatoid factor, anti-fodrin, and anti-muscarinic receptor are often present in patients with Sjogren's syndrome. Conventional therapy includes corticosteroids, and additional more effective therapies would be of benefit.

Immune thrombocytopenic purpura (ITP) is caused by autoantibodies that bind to blood platelets and cause their destruction. Drugs cause some cases of ITP, and others are associated with infection, pregnancy, or autoimmune disease such as SLE. About half of all cases are classified as "idiopathic", meaning the cause is unknown. The treatment of ITP is determined by the severity of the symptoms. In some cases, no therapy is needed although in most cases immunosuppressive drugs, including corticosteroids or intravenous infusions of immune globulin to deplete T cells, are provided. Another treatment that usually results in an increased number of platelets is removal of the spleen, the organ that destroys antibody-coated platelets. More potent immunosuppressive drugs, including cyclosporine, cyclophosphamide, or azathioprine are used for patients with severe cases. Removal of autoantibodies by passage of patients' plasma over a Protein A column is used as a second line treatment in patients with severe disease. Additional more effective therapies are desired.

Multiple sclerosis (MS) is also an autoimmune disease. It is characterized by inflamation of the central nervous system and destruction of myelin, which insulates nerve cell fibers in the brain, spinal cord, and body. Although the cause of MS is unknown, it is widely believed that autoimmune T cells are primary contributors to the pathogenesis of the disease. However, high levels of antibodies are present in the cerebral spinal fluid of patients with MS, and some theories predict that the B cell response leading to antibody production is important for mediating the disease. No B cell depletion therapies have been studies in patients with MS, and there is no cure for MS. Current therapy is corticosteroids, which can reduce the duration and severity of attacks, but do not affect the course of MS over time. New biotechnology interferon (IFN) therapies for MS have recently been approved but additional more effecter therapies are desired.

Myasthenia Gravis (MG) is a chronic autoimmune neuromuscular disorder that is characterized by weakness of the voluntary muscle groups. MG effects about 40,000 people in the united states. MG is caused by autoantibodies that bind to acetylcholine receptors expressed at neuromuscular junctions. The autoantibodies reduce or block acetylcholine receptors, preventing the transmission of signals from nerves to muscles. There is no known cure for mg. Common treatments include immunosuppression with corticosteroids, cyclosporine, cyclophosphamide, or azathioprine. Surgical removal of the thymus is often used to blunt the autoimmune response. Plasmapheresis, used to reduce autoantibody levels in the blood, is effective in mg, but is short-lived because the production of autoantibodies continues. Plasmapheresis is usually reserved for severe muscle weakness prior to surgery. New and effective therapies would be of benefit.

Psoriasis affects approximately five million people, and is characterized by autoimmune inflammation in the skin. Psoriasis is also associated with arthritis in 30% (psoriatic arthritis). Many treatments, including steroids, uv light retenoids, vitamin d derivatives, cyclosporine, methotrexate have been used but it is also plain that psoriasis would benefit from new and effective therapies. Scleroderma is a chronic autoimmune disease of the connective tissue that is also known as systemic sclerosis. Scleroderma is characterized by an overproduction of collagen, resulting in a thickening of the skin, and approximately 300,000 people in the United States have scleroderma, which would also benefit from new and effective therapies.

There is a clear need for improved compositions and methods to treat malignacies, including B cell malignancies and disorders including autoimmune diseases, disorders, and conditions, as well as other diseases, disorders, and conditions. The compositions and methods of the present invention described and claimed herein provide such improved compositions and methods as well as other advantages.

SUMMARY OF THE INVENTION

It is an aspect of the present invention to provide a binding domain-immunoglobulin fusion protein, comprising a binding domain polypeptide that is fused or otherwise connected to an immunoglobulin hinge or hinge-acting region polypeptide, which in turn is fused or otherwise connected to a region comprising one or more native or engineered constant regions from an immunoglobulin heavy chain, other than CH1, for example, the CH2 and CH3 regions of IgG and IgA, or the CH3 and CH4 regions of IgE. The binding domain-immunoglobulin fusion protein further comprises a region that comprises, consists essentially of, or consists of, a native or engineered immunoglobulin heavy chain CH2 constant region polypeptide (or CH3 in the case of a construct derived in whole or in part from IgE) that is fused or otherwise connected to the hinge region polypeptide and a native or engineered immunoglobulin heavy chain CH3 constant region polypeptide (or CH4 in the case of a construct derived in whole or in part from IgE) that is fused or otherwise connected to the CH2 constant region polypeptide (or CH3 in the case of a construct derived in whole or in part from IgE). Such binding domain-immunoglobulin fusion proteins are capable of at least one immunological activity selected from the group consisting of antibody dependent cell-mediated cytotoxicity and complement fixation. Such binding domain polypeptides are also capable of binding or specifically binding to a target, for example, a target antigen.

In certain embodiments, for example, the binding domain polypeptide comprises at least one immunoglobulin variable region polypeptide that is selected from a native or engineered immunoglobulin light chain variable region polypeptide and/or a native or engineered immunoglobulin heavy chain variable region polypeptide. In certain further embodiments the binding domain-immunoglobulin fusion protein comprises a native or engineered immunoglobulin heavy chain variable region polypeptide, wherein the heavy chain variable region polypeptide is an engineered human immunoglobulin heavy chain variable region polypeptide (or an engineered immunoglobulin heavy chain variable region polypeptide from a non-human species) comprising a mutation, substitution, or deletion of an amino acid(s) at a location corresponding to any one or more of amino acid positions 9, 10, 11, 12, 108, 110, and/or 112. Mutations, substitutions, or deletions of an amino acid(s) at a location corresponding to any one or more of amino acid positions 9, 10, 11, 12, 108, 110, and/or 112 in a heavy chain variable region may be included within a construct such as the construct corresponding to, for example, SEQ ID NO:212. In certain embodiments the immunoglobulin variable region polypeptide is derived from, for example, a human immunoglobulin, and in certain other embodiments the immunoglobulin variable region polypeptide comprises a humanized immunoglobulin polypeptide sequence. In certain embodiments the immunoglobulin variable region polypeptide, whether or not humanized, is derived from a murine immunoglobulin, or is derived from an immunoglobulin from another species, including, for example a rat, a pig, a monkey, or a camelid.

According to certain embodiments of the present invention, the binding domain polypeptide comprises, consists essentially of, or consists of, (a) at least one native or engineered immunoglobulin light chain variable region polypeptide; (b) at least one native or engineered immunoglobulin heavy chain variable region polypeptide; and (c) at least one linker polypeptide that is fused or otherwise connected to the polypeptide of (a) and to the polypeptide of (b). In certain further embodiments the native or engineered immunoglobulin light chain variable region and heavy chain variable region polypeptides are derived or constructed from human immunoglobulins, and in certain other further embodiments the linker polypeptide comprises at least one polypeptide including or having as an amino acid sequence Gly-Gly-Gly-Gly-Ser [SEQ ID NO:516]. In other embodiments the linker polypeptide comprises at least two or three repeats of a polypeptide having as an amino acid sequence Gly-Gly-Gly-Gly-Ser [SEQ ID NO:516]. In other embodiments the linker comprises a glycosylation site, which in certain further embodiments is an asparagine-linked glycosylation site, an O-linked glycosylation site, a C-mannosylation site, a glypiation site or a phosphoglycation site. In another embodiment at least one of a native or engineered immunoglobulin heavy chain CH2 constant region polypeptide and a native or engineered immunoglobulin heavy chain CH3 constant region polypeptide is derived from an IgG or IgA human immunoglobulin heavy chain. In another embodiment at least one of a native or engineered immunoglobulin heavy chain CH3 constant region polypeptide and a native or engineered immunoglobulin heavy chain CH4 constant region polypeptide is derived from an IgE human immunoglobulin heavy chain.

An immunoglobulin hinge region polypeptide may comprise, consist essentially or, or consist of, for example, any of (1) any hinge or hinge-acting peptide or polypeptide that occurs naturally for example, a human immunoglobulin hinge region polypeptide including, for example, a wild-type human IgG hinge or a portion thereof, a wild-type human IgA hinge or a portion thereof, a wild-type human IgD hinge or a portion thereof, or a wild-type human IgE hinge-acting region, i.e., IgE CH2, or a portion thereof, a wild-type camelid hinge region or a portion thereof (including a IgG1 llama hinge region or portion thereof, a IgG2 llama hinge region or portion thereof, and a IgG3 llama hinge region or portion thereof), a nurse shark hinge region or portion thereof, and/or a spotted ratfish hinge region or a portion thereof; (2) a mutated or otherwise altered or engineered hinge region polypeptide that contains no cysteine residues and that is derived or constructed from a wild-type immunoglobulin hinge region polypeptide having one or more cysteine residues; (3) a mutated or otherwise altered or engineered hinge region polypeptide that contains one cysteine residue and that is derived from a wild-type immunoglobulin hinge region polypeptide having one or more cysteine residues; (4) a hinge region polypeptide that has been mutated or otherwise altered or engineered to contain or add one or more glycosylation sites, for example, an asparagine-linked glycosylation site, an O-linked glycosylation site, a C-mannosylation site, a glypiation site or a phosphoglycation site; (5) a mutated or otherwise altered or engineered hinge region polypeptide in which the number of cysteine residues is reduced by amino acid substitution or deletion, for example, a mutated or otherwise altered or engineered IgG1 or IgG4 hinge region containing for example zero, one, or two cysteine residues, a mutated or otherwise altered or engineered IgG2 hinge region containing for example zero, one, two or three cysteine residues, a mutated or otherwise altered or engineered IgG3 hinge region containing for example zero, one, two, three, or from four to ten cysteine residues, or a mutated or otherwise altered or engineered human IgA1 or IgA2 hinge region polypeptide that contains zero or only one or two cysteine residues (e.g., an "SCC" hinge), a mutated or otherwise altered or engineered IgD hinge region containing no cysteine residues, or a mutated or otherwise altered or engineered human IgE hinge-acting region, i.e., IgE CH2 region polypeptide that contains zero or only one, two, three or four cysteine residues; or (6) any other connecting region molecule described or referenced herein or otherwise known or later discovered as useful for connecting adjoining immunoglobulin domains such as, for example, a CH1 domain and a CH2 domain. For example, a hinge region polypeptide may be selected from the group consisting of (i) a wild-type human IgG1 immunoglobulin hinge region polypeptide, for example, (ii) a mutated or otherwise altered or engineered human IgG1 or other immunoglobulin hinge region polypeptide that is derived or constructed from a wild-type immunoglobulin hinge region polypeptide having three or more cysteine residues, wherein said mutated human IgG1 or other immunoglobulin hinge region polypeptide contains two cysteine residues and wherein a first cysteine of the wild-type hinge region is not mutated, (iii) a mutated or otherwise altered or engineered human IgG1 or other immunoglobulin hinge region polypeptide that is derived from a wild-type immunoglobulin hinge region polypeptide having three or more cysteine residues, wherein said mutated human IgG1 or other immunoglobulin hinge region polypeptide contains no more than one cysteine residue, and (iv) a mutated or otherwise altered or engineered human IgG1 or other immunoglobulin hinge region polypeptide that is derived from a wild-type immunoglobulin hinge region polypeptide having three or more cysteine residues, wherein said mutated or otherwise altered or engineered human IgG1 or other immunoglobulin hinge region polypeptide contains no cysteine residues. In certain embodiments, for example, the immunoglobulin hinge region polypeptide is a mutated or otherwise altered or engineered hinge region polypeptide and exhibits a reduced ability to dimerize, relative to a wild-type human immunoglobulin G or other wild type hinge region or hinge-acting polypeptide.

The immunoglobulin heavy chain constant region polypeptides may be, for example, native or engineered CH2 and CH3 domains of an isotype that is human IgG or human IgA. The immunoglobulin heavy chain constant region polypeptides may also be, for example, native or engineered immunoglobulin heavy chain constant region CH3 and CH4 polypeptides of an isotype that is human IgE.

In certain other embodiments the target or target antigen may be, for example, CD19 (B-lymphocyte antigen CD19, also referred to as B-lymphocyte surface antigen B4, or Leu-12), CD20 (B-lymphocyte antigen 20, also referred to as B-lymphocyte surface antigen B1, Leu-16, or Bp35), CD22 (B-cell receptor CD22, also referred to as Leu-14, B-lymphocyte cell adhesion molecule, or BL-CAM), CD37 (leukocyte antigen CD37), CD40 (B-cell surface antigen CD40, also referred to as Tumor Necrosis Factor receptor superfamily member 5, CD40L receptor, or Bp50), CD80 (T lymphocyte activation antigen CD80, also referred to as Activation B7-1 antigen, B7, B7-1, or BB1), CD86 (T lymphocyte activation antigen CD86, also referred to as Activation B7-2 antigen, B70, FUN-1, or BU63), CD137 (also referred to as Tumor Necrosis Factor receptor superfamily member 9), CD152 (also referred to as cytotoxic T-lymphocyte protein 4 or CTLA-4), CD45 (Leukocyte common antigen, also referred to as L-CA, T200, and EC 3.1.3.48), CD45RA (an isoform of CD45, and an antigen expressed on naïve or immature lymphocytes), CD45RB (an isoform of CD45), CD45RO (an isoform of CD45, and a common leukocyte antigen expressed on memory B and T cells), L6 (Tumor-associated antigen L6, also referred to as Transmembrane 4 superfamily member 1, Membrane component surface marker 1, or M3S1), CD2 (T-cell surface antigen CD2, also referred to as T-cell surface antigen T11/Leu-5, LFA-2, LFA-3 receptor, Erythrocyte receptor, or Rosette receptor), CD28 (T-cell-specific homodimer surface protein CD28, also referred to as Tp44), CD30 (lymphocyte activation antigen CD30, also referred to as Tumor Necrosis Factor receptor superfamily member 8, CD30L receptor, or Ki-1), LD50 (also referred to as Intercellular adhesion molecule-3 (ICAM3), or ICAM-R), CD54 (also referred to as Intercellular adhesion molecule-1 (ICAM1), or Major group rhinovirus receptor), B7-H1 (ligand for an immunoinhibitory receptor expressed by activated T cells, B cells, and myeloid cells, also referred to as PD-L1; see Dong, et al., "B7-H1, a third member of the B7 family, co-stimulates T-cell proliferation and interleukin-10 secretion," 1999 Nat. Med. 5:1365-1369), CD134 (also referred to as Tumor Necrosis Factor receptor superfamily member 4,OX40, OX40L receptor, ACT35 antigen, or TAX-transcriptionally activated glycoprotein 1 receptor), 41 BB (4-1 BB ligand receptor, T-cell antigen 4-1BB, or T-cell antigen ILA), CD153 (also referred to as Tumor Necrosis Factor ligand superfamily member 8, CD30 ligand, or CD30-L), CD154 (also referred to as Tumor Necrosis Factor ligand superfamily member 5, CD40 ligand, CD40-L, TNF-related activation protein, TRAP, or T cell antigen Gp39), ICOS (Inducible Costimulator), CD3 (one or more of the delta, epsilon, gamma, eta and/or zeta chains, alone or in combination), CD4 (T-cell surface glycoprotein CD4, also referred to as T-cell surface antigen T4/Leu-3), CD25 (also referred to as Interleukin-2 receptor alpha chain, IL-2 receptor alpha subunit, p55, or Tac antigen), CD8a (T-cell surface glycoprotein CD8 alpha chain, also referred to as T-lymphocyte differentiation antigen, T8/Leu-2, and Lyt-2), CD11b (also referred to as Integrin alpha-M, Cell surface glycoprotein MAC-1 alpha subunit, CR-3 alpha chain, Leukocyte adhesion receptor Mol, or Neutrophil adherence receptor), CD14 (Monocyte differentiation antigen CD14, also referred to as Myeloid cell-specific leucine-rich glycoprotein or LPS receptor), CD56 (also referred to as Neural cell adhesion molecule 1), or CD69 (also referred to as Early T-cell activation antigen p60, Gp32/28, Leu-23, MLR-3, Activation inducer molecule, or AIM), and TNF factors (for example TNF-α). The above list of construct targets and/or target antigens is exemplary only and is not exhaustive.

In another aspect, the invention includes a binding construct (or a polynucleotide encoding such a construct) that comprises a CD154 extracellular domain, or desired functional portion thereof. In one embodiment of this aspect of the invention, for example, the binding construct comprises a CD154 extracellular domain fused or otherwise connected to a second binding domain. The second binding domain, for example, may comprise, consist essentially of, or consist of at least one immunoglobulin variable region polypeptide. The at least one immunoglobulin variable region polypeptide may be a native or engineered scFv. The native or engineered scFv may be a native or engineered scFv disclosed or described herein. The second binding domain, including a native or engineered scFv, may be one that binds, for example, to any of the targets, including target antigens, disclosed or described herein, including but not limited to, for example, any of B7-H1, ICOS, L6, CD2, CD3, CD8, CD4, CD11b, CD14, CD19, CD20, CD22, CD25, CD28, CD30, CD37, CD40, CD45, CD50, CD54, CD56, CD69, CD80, CD86, CD134, CD137, CD152, CD153, or CD154.

In another embodiment the binding domain polypeptide comprises a CTLA-4 extracellular domain, or desired functional portion thereof, and in further embodiments at least one of the immunoglobulin heavy chain constant region polypeptides selected from a CH2 constant region polypeptide and a CH3 constant region polypeptide is a human IgG1 constant region polypeptide, either native or engineered.

In another further embodiment at least one of the immunoglobulin heavy chain constant region polypeptides selected from a CH2 constant region polypeptide and a CH3 constant region polypeptide is a human IgA constant region polypeptide, either native or engineered.

In another further embodiment at least one of the immunoglobulin heavy chain constant region polypeptides selected from a CH3 constant region polypeptide and a CH4 constant region polypeptide is a human IgE constant region polypeptide, either native or engineered.

Turning to another embodiment, the present invention provides a binding domain-immunoglobulin fusion protein, comprising, consisting essentially of, or consisting of, (a) a binding domain polypeptide that is fused or otherwise connected to an immunoglobulin hinge region polypeptide; (b) a native or engineered immunoglobulin heavy chain CH2 (or IgE Ch3) constant region polypeptide that is fused or otherwise connected to the hinge region polypeptide; and (c) a native or engineered immunoglobulin heavy chain CH3 (or IgE CH4) constant region polypeptide that is fused or otherwise connected to the CH2 (or IgE CH3) constant region polypeptide, wherein (1) the binding domain polypeptide comprises a CTLA-4 extracellular domain, or a portion thereof, that is capable of binding or specifically binding to at least one CTLA-4 ligand selected from the group consisting of CD80 and CD86, (2) the immunoglobulin hinge region polypeptide may be as described above or herein, and may comprise, consist essentially of, or consist of, for example, a polypeptide that is selected from the group consisting of a native or engineered human IgA hinge region polypeptide, a native or engineered human IgG1 hinge region polypeptide, and a native or engineered human IgE CH2 region polypeptide (3) a immunoglobulin heavy chain constant region polypeptide that comprises, consists essentially of, or consists of, a polypeptide that is selected from the group consisting of a native or engineered human IgA heavy chain CH2 constant region polypeptide, a native or engineered human IgG1 heavy chain CH2 constant region polypeptide, and a native or engineered human IgE heavy chain CH3 constant region polypeptide (4) a immunoglobulin heavy chain constant region polypeptide that comprises, consists essentially of, or consists of, a polypeptide that is selected from the group consisting of a native or engineered human IgA heavy chain CH3 constant region polypeptide, a native or engineered human IgG1 heavy chain CH3 constant region polypeptide, and a native or engineered human IgE heavy chain CH4 constant region polypeptide, and (5) the binding domain-immunoglobulin fusion protein is capable of inducing at least one immunological activity selected from the group consisting of antibody dependent cell-mediated cytotoxicity, CDC, and complement fixation. In a further embodiment, the binding domain-immunoglobulin fusion protein is capable of inducing two immunological activities selected from the group consisting of antibody dependent cell-mediated cytotoxicity, CDC, and complement fixation.

In another embodiment the present invention provides a binding domain-immunoglobulin fusion protein, comprising, consisting essentially of, or consisting of (a) a binding domain polypeptide that is fused or otherwise connected to an immunoglobulin hinge region polypeptide, wherein said hinge region polypeptide may be as described above or herein, and may comprise, consist essentially of, or consist of, for example, a native or engineered human IgE hinge-acting region, i.e., a IgE CH2 region polypeptide; (b) a first native or engineered immunoglobulin heavy chain constant region polypeptide that is fused or otherwise connected to the hinge region polypeptide, wherein said native or engineered constant region polypeptide comprises, consists essentially of, or consists of, a native or engineered human IgE CH3 constant region polypeptide; and (c) a second native or engineered immunoglobulin heavy chain constant region polypeptide that is fused or otherwise connected to the first native or engineered constant region polypeptide, wherein said native or engineered second constant region polypeptide comprises, consists essentially of, or consists of, a native or engineered human IgE CH4 constant region polypeptide and wherein (1) the binding domain-immunoglobulin fusion protein is capable of inducing at least one immunological activity selected from antibody dependent cell-mediated cytotoxicity and induction of an allergic response mechanism, and (2) the binding domain polypeptide is capable of binding or specifically binding to an antigen. In a further embodiment the antigen is a tumor antigen.

In certain other embodiments the present invention provides a binding domain-immunoglobulin fusion protein, comprising, consisting essentially of, or consisting of, (a) a binding domain polypeptide that is fused or otherwise connected to an immunoglobulin hinge region polypeptide, wherein the binding domain polypeptide is capable of binding or specifically binding to at least one antigen that is present on an immune effector cell and wherein the hinge region polypeptide may be as described above or herein, and may comprise, consist essentially of, or consist of, for example, a polypeptide selected from the group consisting of a native or engineered human IgA hinge region polypeptide, a native or engineered human IgG hinge region polypeptide, and a native or engineered human IgE hinge-acting region, i.e., IgE CH2 region polypeptide; (b) a first native or engineered immunoglobulin heavy chain constant region polypeptide that is fused or otherwise connected to the hinge region polypeptide, wherein said first native or engineered constant region polypeptide comprises, consists essentially of, or consists of, a polypeptide selected from the group consisting of a native or engineered human IgA CH2 constant region polypeptide, a native or engineered human IgG CH2 constant region polypeptide, and a native or engineered human IgE CH3 constant region polypeptide; (c) a second native or engineered immunoglobulin heavy chain constant region polypeptide that is fused or otherwise connected to the first constant region polypeptide, wherein said second constant region polypeptide comprises, consists essentially of, or consists of, a polypeptide selected from the group consisting of a native or engineered human IgA CH3 constant region polypeptide, a native or engineered human IgG CH3 constant region polypeptide, and a native or engineered human IgE CH4 constant region polypeptide; and (d) a native or engineered plasma membrane anchor domain polypeptide. In one example of this embodiment, the plasma membrane anchor domain polypeptide links to a membrane via a native or engineered glycosyl-phosphatidylinositol-linkage. In a further embodiment the plasma membrane anchor domain polypeptide comprises, consists essentially of, or consists of, a native or engineered transmembrane domain polypeptide. In another further embodiment the membrane anchor domain polypeptide comprises, consists essentially of, or consists of, a native or engineered transmembrane domain polypeptide and a native or engineered cytoplasmic tail polypeptide. In a still further embodiment the cytoplasmic tail polypeptide comprises, consists essentially of, or consists of, a native or engineered apoptosis signaling polypeptide sequence, which in a still further embodiment is derived or constructed from a native or engineered receptor death domain polypeptide, a death domain, or a functional portion of either. In a further embodiment the native or engineered death domain polypeptide comprises, consists essentially of, or consists of, for example, a native or engineered polypeptide selected from an ITIM domain (immunoreceptor Tyr-based inhibition motif), an ITAM domain (immunoreceptor Tyr-based activation motif), TRAF, RIP, CRADD, FADD (Fas-associated death domain), TRADD (Tumor Necrosis Factor receptor type 1 associated DEATH domain protein), RAIDD (also referred to as RAID), CD95 (Tumor Necrosis Factor receptor superfamily member 6, also referred to as FASL receptor, Apoptosis-mediating surface antigen FAS, FAS and Apo-1 antigen), TNFR1, and/or DR5 (death receptor-5). In another embodiment the native or engineered apoptosis signaling polypeptide sequence comprises, consists essentially of, or consists of, for example, a polypeptide sequence derived from a native or engineered caspase polypeptide that is caspase-3 or caspase-8 or caspase-10, including caspase 8/FLICE/MACH/Mch5 and caspase 10/Flice2/Mch4. In another embodiment the plasma membrane anchor domain polypeptide comprises, consists essentially of, or consists of, for example, a native or engineered glycosyl-phosphatidylinositol-linkage polypeptide sequence. In another embodiment the antigen that is present on an immune effector cell is, for example, CD2, CD16, CD28, CD30, CD32, CD40, CD50, CD54, CD64, CD80, CD86, B7-H1, CD134, CD137, CD152, CD153, CD154, ICOS, CD19, CD20, CD22, CD37, L6, CD3, CD4, CD25, CD8, CD11b, CD14, CD56, or CD69. In another embodiment the human IgG is a native or engineered human IgG1. These binding domain-immunoglobulin fusion proteins may be capable of inducing, for example, at least one immunological activity selected from antibody dependent cell-mediated cytotoxicity and/or complement fixation and/or CDC, and are capable of binding or specifically binding to a target, including, for example, a target antigen. In other embodiments, the binding domain-immunoglobulin fusion proteins may be capable of inducing, for example, two immunological activities selected from antibody dependent cell-mediated cytotoxicity and/or complement fixation and/or CDC, and are capable of binding or specifically binding to a target. Immune effector cells include, for example, granulocytes, mast cells, monocytes, macrophages, dendritic cells, neutrophils, eosinophils, basophils, NK cells, T cells (including Th1 cells, Th2 cells, Tc cells, memory T cells, null cells, and large granular lymphocytes, etc.), and B cells. This embodiment of the invention further includes the use of such proteins for therapy, and, for example, the use of such vectors for in vivo and ex vivo gene therapy. The above lists of construct components and targets are not exhaustive and may include any desired target or component that may function as, or be useful for the purposes, described herein.

In another embodiment, the invention provides a protein having a first protein motif that comprises, consists essentially of, or consists of, (1) a native or engineered immunoglobulin hinge region or hinge-acting region (e.g., IgE CH2) polypeptide that is fused or otherwise connected to (2) a native or engineered CH2 constant region polypeptide (or native or engineered IgE CH3 constant region polypeptide). Said first protein motif may be fused or otherwise connected to one or more other such first protein motifs to form a second protein motif, the second protein motif being fused or otherwise connected to (3) a native or engineered CH3 constant region (or a native or engineered IgE CH4 constant region) to form a third protein motif. Said first, second or third protein motifs may be fused or otherwise connected to one or more of the herein-described native or engineered plasma membrane anchor domain polypeptides, including, for example, a native or engineered transmembrane domain polypeptide, and a native or engineered transmembrane domain polypeptide and a native or engineered cytoplasmic tail polypeptide, such as for example, a native or engineered apoptosis signaling polypeptide sequence, which may be derived or constructed from a native or engineered receptor death domain polypeptide, a death domain, or a functional portion of either. Thus, a protein or polynucleiotide within this aspect of the invention may be, for example, a Hinge-CH2-CH3-TransmembraneDomain-DeathDomain construct. It may also be, for example, a (Hinge-CH2)$_x$—CH3-TransmembraneDomain-DeathDomain construct, where X is from 2 to about 5, or such other number as may be needed to achieve a desired length or Fc receptor binding and/or complement fixation function(s). This embodiment of the invention also includes polynucleotides encoding such proteins, vectors including such polynucleotides, and host cells containing such polynucleotides and vectors. This embodiment of the invention further includes the use of such proteins for therapy, and, for example, the use of such polynuceotides and/or vectors for in vivo and ex vivo gene therapy. The invention provides, in another embodiment, a binding domain-immunoglobulin fusion protein, comprising, consisting essentially of, or consisting of, (a) a binding domain polypeptide that is fused or otherwise connected to an immunoglobulin hinge region polypeptide, wherein the binding domain polypeptide is capable of binding or specifically binding to at least one antigen that is present on a cancer cell surface and wherein the hinge region polypeptide may be as described above or herein, and may comprise, consist essentially of, or consist of, for example, a polypeptide selected from the group consisting of a native or engineered human IgA hinge region polypeptide, a native or engineered human IgG hinge region polypeptide, and a native or engineered human IgE hinge-acting region, i.e., IgE CH2, region polypeptide; (b) a first native or engineered immunoglobulin heavy chain constant region polypeptide that is fused or otherwise connected to the hinge region polypeptide, wherein the first constant region polypeptide comprises, consists essentially of, or consists of, a polypeptide that is a native or engineered human IgA CH2 constant region polypeptide, a native or engineered human IgG CH2 constant region polypeptide, or a native or engineered human IgE CH3 constant region polypeptide; and (c) a second native or engineered immunoglobulin heavy chain constant region polypeptide that is fused or otherwise connected to the first constant region polypeptide, wherein the second constant region polypeptide comprises, consists essentially of, or consists of, a polypeptide that is a native or engineered human IgA CH3 constant region polypeptide, a native or engineered human IgG CH3 constant region polypeptide, or a native or engineered human IgE CH4 constant region polypeptide. In a further embodiment the human IgG polypepdides are native or engineered human IgG1 polypeptides.

In another embodiment the present invention provides a binding domain-immunoglobulin fusion protein, comprising, consisting essentially of, or consisting of, (a) a binding domain polypeptide that is fused or otherwise connected to an immunoglobulin hinge region polypeptide, wherein said hinge region polypeptide may be as described above or herein, and may comprises, consist essentially of, or consist of, for example, a wild-type or engineered human IgA hinge region polypeptide; (b) a native or engineered immunoglobulin heavy chain CH2 constant region polypeptide that is fused or otherwise connected to the hinge region polypeptide, wherein said native or engineered CH2 constant region polypeptide comprises, consists essentially of, or consists of, a native or engineered human IgA CH2 constant region polypeptide; and (c) a native or engineered immunoglobulin heavy chain CH3 constant region polypeptide that is fused or otherwise connected to the native or engineered CH2 constant region polypeptide, wherein the native or engineered CH3 constant region polypeptide comprises, consists essentially of, or consists of, a polypeptide that is (i) a wild-type human IgA CH3 constant region polypeptide or other IgA region, preferably human or humanized, that is capable of associating with J Chain, (ii) a mutated, altered or otherwise engineered human IgA CH3 constant region polypeptide that is, for example, incapable of associating with a J chain, wherein (1) the binding domain-immunoglobulin fusion protein is capable of at least one immunological activity selected from the group consisting of antibody dependent cell-mediated cytotoxicity, CDC, and complement fixation, and (2) the binding domain polypeptide is capable of binding or specifically binding to a target such as, for example, an antigen. In certain further embodiments the mutated human IgA CH3 constant region polypeptide that is incapable of associating with a J chain is (i) a polypeptide comprising, consisting essentially of, or consisting of, an amino acid sequence as set forth in SEQ ID NO:69 or (ii) a polypeptide comprising, consisting essentially of, or consisting of, an amino acid sequence as set forth in SEQ ID NO:74. In other embodiments, the IgA hinge region polypeptide is a native or engineered IgA1 hinge region polypeptide or a native or engineered IgA2 hinge region polypeptide. In still other embodiments, the IgA hinge region polypeptide is different from a wild-type IgA1 or IgA2 hinge region polypeptide by, for example, the alteration, substitution, or deltion of one or more of the cysteine residues within said wild-type hinge region.

In certain other embodiments the present invention provides a binding domain-immunoglobulin fusion protein, comprising, consisting essentially of, or consisting of (a) a binding domain polypeptide that is fused or otherwise connected to an immunoglobulin hinge region polypeptide; (b) a native or engineered immunoglobulin heavy chain CH2 constant region polypeptide that is fused or otherwise connected to the hinge region polypeptide, wherein the native or engineered CH2 constant region polypeptide comprises, consists essentially of, or consists of, a native or engineered llama CH2 constant region polypeptide that is a native or engineered llama IgG1 CH2 constant region polypeptide, a native or engineered llama IgG2 CH2 constant region polypeptide, or a native or engineered llama IgG3 CH2 constant region polypeptide; and (c) a native or engineered immunoglobulin heavy chain CH3 constant region polypeptide that is fused or otherwise connected to the native or engineered CH2 constant region polypeptide, wherein said native or engineered CH3 constant region polypeptide comprises, consists essentially of, or consists of, a native or engineered llama CH3 constant region polypeptide that is selected from the group consisting of a native or engineered llama IgG1 CH3 constant region polypeptide, a native or engineered llama IgG2 CH3 constant region polypeptide and a native or engineered llama IgG3 CH3 constant region polypeptide wherein (1) the binding domain-immunoglobulin fusion protein is capable of at least one immunological activity selected from the group consisting of antibody dependent cell-mediated cytotoxicity, fixation of complement and CDC, and (2) the binding domain polypeptide is capable of binding or specifically binding to a target, for example a target antigen. In a further embodiment the immunoglobulin hinge region polypeptide, the native or engineered llama CH2 constant region polypeptide and the native or engineered llama CH3 constant region polypeptide comprise sequences derived from a native or engineered llama IgG1 polypeptide and the fusion protein does not include a native or engineered llama IgG1 CH1 domain. In certain embodiments the invention provides any of the above described binding domain-immunoglobulin fusion proteins wherein the hinge region polypeptide is mutated, engineered, or otherwise altered to contain a glycosylation site, which in certain further embodiments is an asparagine-linked glycosylation site, an O-linked glycosylation site, a C-mannosylation site, a glypiation site or a phosphoglycation site.

In certain embodiments the invention, there are provided any of the above or herein described binding constructs, including binding domain-immunoglobulin fusion proteins, wherein a binding region or binding domain polypeptide comprises two or more binding domain polypeptide sequences wherein each of the binding domain polypeptide sequences is capable of binding or specifically binding to a target(s) such as an antigen(s), which target(s) or antigen(s) may be the same or may be different. A native, for more preferably an engineered, IgD hinge is a desired connecting region between binding domains of a bispecific molecule of the invention, i.e., one with two or more binding domains, preferably two. The wild type human IgD hinge has one cysteine that forms a disulfide bond with the light chain in the native IgD structure. It is desirable to mutate or delete this cysteine in the human IgD hinge for use as a connecting region between binding domains of, for example, a bispecific molecule. Other amino acid changes or deletions or alterations in an IgD hinge that do not result in undesired hinge inflexibility are within the scope of the invention. Native or engineered IgD hinge regions from other species are also within the scope of the invention, as are humanized native or engineered IgD hinges from non-human species. The present invention also provides, in certain embodiments, a binding domain-immunoglobulin fusion protein, comprising, consisting essentially of, or consisting of (a) a binding domain polypeptide that is fused or otherwise connected to an immunoglobulin hinge region polypeptide, wherein the hinge region polypeptide may be as described above or herein, and may comprise, consist essentially of, or consist of, for example, an alternative hinge region polypeptide sequence; (b) a first native or engineered immunoglobulin heavy chain constant region, such as an IgG or IgA CH2 constant region polypeptide (or an IgE CH3 constant region polypeptide) that is fused or otherwise connected to the hinge region polypeptide; and (c) a second native or engineered immunoglobulin heavy chain constant region, such as an IgG or IgA CH3 constant region polypeptide (or an IgE CH4 constant region polypeptide) that is fused or otherwise connected to the first constant region polypeptide, wherein: (1) the binding domain-immunoglobulin fusion protein is capable of at least one immunological activity selected from the group consisting of antibody dependent cell-mediated cytotoxicity, CDC, and complement fixation, and (2) the binding domain polypeptide is capable of binding or specifically binding to a target, such as an antigen.

Turning to another embodiment there is provided a binding domain-immunoglobulin fusion protein, comprising, consisting essentially of, or consisting of (a) a binding domain polypeptide that is fused or otherwise connected to an immunoglobulin hinge region polypeptide, wherein the binding domain polypeptide is capable of binding or specifically binding to at least one target, such as an antigen, that is present on a cancer cell surface and wherein the hinge region polypeptide may be as described above or herein, and may comprise, consist essentially of, or consist of, for example, an alternative hinge region polypeptide sequence; (b) a first native or engineered immunoglobulin heavy chain constant region polypeptide that is fused or otherwise connected to the hinge region polypeptide, wherein said native or engineered constant region polypeptide comprises, consists essentially of, or consists of, a polypeptide selected from the group consisting of a native or engineered human IgA CH2 constant region polypeptide, a native or engineered human IgG CH2 constant region polypeptide, and a native or engineered human IgE CH3 constant region polypeptide; and (c) a second immunoglobulin heavy chain constant region polypeptide that is fused or otherwise connected to the first constant region polypeptide, wherein the second constant region polypeptide comprises, consists essentially of, or consists of, a polypeptide that is a native or engineered human IgA CH3 constant region polypeptide, a native or engineered human IgG CH3 constant region polypeptide, or a native or engineered human IgE CH4 constant region polypeptide. In certain further embodiments the alternative hinge region polypeptide sequence comprises, consists essentially of, or consists of, a polypeptide sequence of at least ten continuous amino acids of an Ig hinge region in any one of the constructs set out herein.

In certain embodiments the present invention provides polynucleotides or vectors (including cloning vectors and expression vectors) or transformed or transfected cells, including isolated or purified or pure polynucleotides, vectors, and isolated transformed or transfected cells, encoding or containing any one of the above or herein described polypeptide or protein constructs of the invention, for example, including binding domain-immunoglobulin fusion proteins. Thus, in various embodiments the invention provides a recombinant cloning or expression construct comprising any such polynucleotide that is operably linked to a promoter.

In other embodiments there is provided a host cell transformed or transfected with, or otherwise containing, any such recombinant cloning or expression construct. Host cells include the cells of a subject undergoing ex vivo cell therapy including, for example, ex vivo gene therapy.

In a related embodiment there is provided a method of producing a polypeptide or protein or other construct of the invention, for example, including a binding domain-immunoglobulin fusion protein, comprising the steps of (a) culturing a host cell as described or provided for herein under conditions that permit expression of the construct, for example, a binding domain-immunoglobulin fusion protein; and (b) isolating the construct, for example, the binding domain-immunoglobulin fusion protein from the host cell or host cell culture.

In another embodiment there is provided a pharmaceutical composition comprising any one of the above or herein described polypeptide or protein or other constructs of the invention, for example (including, for example, binding domain-immunoglobulin fusion proteins), in combination with a physiologically acceptable carrier.

In another embodiment the invention provides a pharmaceutical composition comprising, for example, an isolated, purified, or pure polynucleotide encoding any one of the polypeptide or protein constructs of the invention, for example (including, for example, binding domain-immunoglobulin fusion proteins), in combination with a physiologically acceptable carrier, or for example, in combination with, or in, a gene therapy delivery vehicle or vector.

In another embodiment the invention provides a method of treating a subject having or suspected of having a malignant condition or a B cell disorder, comprising administering to a patient a therapeutically effective amount of any of the pharmaceutical compositions described or claimed herein.

In certain further embodiments the malignant condition or B cell disorder is a B cell lymphoma or B cell leukemia, or a disease characterized by autoantibody production, and in certain other further embodiments the B cell disorder is, for example, rheumatoid arthritis, myasthenia gravis, Grave's disease, type I diabetes mellitus, multiple sclerosis or an autoimmune disease. In certain other embodiments the malignant condition is, for example, melanoma, myeloma, glioma, astrocytoma, lymphoma, leukemia, carcinoma, or sarcoma, and so on.

It is another aspect of the present invention to provide a binding domain-immunoglobulin fusion protein, comprising, consisting essentially or, or consisting of, (a) a binding domain polypeptide that is fused or otherwise connected to an immunoglobulin hinge region polypeptide, wherein said hinge region polypeptide is as described herein, and may be selected from the group consisting of (i) a mutated, engineered or otherwise altered hinge region polypeptide that contains no cysteine residues and that is derived from a wild-type immunoglobulin hinge region polypeptide having one or more cysteine residues, (ii) a mutated, engineered or otherwise altered hinge region polypeptide that contains one cysteine residue and that is derived from a wild-type immunoglobulin hinge region polypeptide having two or more cysteine residues, (iii) a wild-type human IgA hinge region polypeptide, (iv) a mutated, engineered or otherwise altered human IgA hinge region polypeptide that contains no cysteine residues, (v) a mutated, engineered or otherwise altered human IgA hinge region polypeptide that contains one cysteine residue and (vi) a mutated, engineered or otherwise altered human IgA hinge region polypeptide that contains two cysteine residues; (b) a native or engineered immunoglobulin heavy chain CH2 constant region polypeptide that is fused or otherwise connected to the hinge region polypeptide; and (c) a native or engineered immunoglobulin heavy chain CH3 constant region polypeptide that is fused or otherwise connected to the CH2 constant region polypeptide, wherein: (1) the binding domain-immunoglobulin fusion protein is capable of at least one immunological activity selected from the group consisting of antibody dependent cell-mediated cytotoxicity and complement fixation, and (2) the binding domain polypeptide is capable of binding or specifically binding to an antigen. In one embodiment the immunoglobulin hinge region polypeptide is a mutated hinge region polypeptide, for example, and the resulting construct exhibits a reduced ability to dimerize, relative to a construct containing a wild-type human immunoglobulin G hinge region polypeptide. In another embodiment the binding domain polypeptide comprises, consists essentially of, or consists of, at least one native or engineered immunoglobulin variable region polypeptide that is a native or engineered immunoglobulin light chain variable region polypeptide and/or a native or engineered immunoglobulin heavy chain variable region polypeptide. In a further embodiment the native or engineered immunoglobulin variable region polypeptide is derived from a human immunoglobulin and, for example, may be humanized.

In another embodiment, the invention provides a binding domain-immunoglobulin fusion protein includes a binding domain polypeptide that comprises, consists essentially of, or consists of, (a) at least one native or engineered immunoglobulin light chain variable region polypeptide; (b) at least one native or engineered immunoglobulin heavy chain variable region polypeptide; and (c) at least one linker peptide that is fused or otherwise connected to the polypeptide of (a) and to the polypeptide of (b). In a further embodiment the native or engineered immunoglobulin light chain variable region and the native or engineered heavy chain variable region polypeptides are derived from human immunoglobulins and may, for example, be humanized.

In another embodiment at least one of the native or engineered immunoglobulin heavy chain CH2 (or IgE CH3) constant region polypeptide and the native or engineered immunoglobulin heavy chain CH3 (or IgE CH4) constant region polypeptide is derived or constructed from a human immunoglobulin heavy chain. In another embodiment the native or engineered immunoglobulin heavy chain constant region CH2 and CH3 polypeptides are of, or are derived or otherwise prepared or constructed from, an isotype selected from human IgG and human IgA. In another embodiment the target, for example, the target antigen is selected from the group consisting of CD16, CD19, CD20, CD37, CD40, CD45RO, CD80, CD86, CD137, CD152, and L6. In certain further embodiments of the above described fusion protein construct, the binding domain comprises, consists essentially of, or consists of, an scFv and the scFv contains a linker polypeptide that comprises, consists essentially of, or consists of, at least one polypeptide comprising or having as an amino acid sequence Gly-Gly-Gly-Gly-Ser [SEQ ID NO:516], and in certain other embodiments the linker polypeptide comprises, consists essentially of, or consists of, at least three repeats of a polypeptide having as an amino acid sequence Gly-Gly-Gly-Gly-Ser [SEQ ID NO:516]. In certain embodiments the immunoglobulin hinge region polypeptide comprises, consists essentially of, or consists of, a native or engineered human IdG, IgA, IgD hinge region polypeptide, or a native or engineered IgE CH2 region polypeptide. In certain embodiments the binding domain polypeptide comprises, consists essentially of, or consists of, a native or engineered CD154 extracellular domain. In certain embodiments the binding domain polypeptide comprises, consists essentially of, or consists of, a native or engineered CD154 extracellular domain and at least one a native or engineered immunoglobulin variable region polypeptide.

In other embodiments the invention provides an isolated polynucleotide encoding any of the constructs of the invention, for example, protein or polypeptide constructs of the invention including binding domain-immunoglobulin fusion proteins, and in related embodiments the invention provides a recombinant expression construct comprising such a polynucleotide, and in certain further embodiments the invention provides a host cell transformed or transfected with, or otherwise containing, such a recombinant expression construct. In another embodiment the invention provides a method of producing a construct of the invention, for example, a protein or polypeptide construct of the invention such as a binding domain-immunoglobulin fusion protein, comprising the steps of (a) culturing a host cell that has been transformed or transfected with, or otherwise made to contain, a polynucleotide construct of the invention under conditions that permit expression of the construct, for example, a construct encoding a binding domain-immunoglobulin fusion protein; and (b) isolating the construct, for example, the binding domain-immunoglobulin fusion protein, from the host cell culture.

The inventions described and claimed herein include novel molecules useful, for example, as therapeutics and other purposes including diagnostic and research purposes. Such molecules have, for example, antigen binding or other binding function(s) and one or more effector functions. DNA constructs of the invention are useful in, for example, gene therapies, including in vivo and ex vivo gene therapies.

In one aspect, various constructs of the molecules of the invention include molecules comprising a "binding region", a "tail" region, and a "connecting" region that joins a binding region and a tail region.

Binding regions within the molecules of the invention may comprise, for example, binding domains for desired targets, including antigen-binding targets. Binding domains for antigen-binding targets may comprise, for example, single chain Fvs and scFv domains. In certain embodiments, molecules of the invention may comprise a binding region having at least one immunoglobulin variable region polypeptide, which may be a light chain or a heavy chain variable region polypeptide. In certain embodiments, molecules of the invention may comprise at least one such light chain V-region and one such heavy chain V-region and at least one linker peptide that connects the V-regions. ScFvs useful in the invention also include those with chimeric binding or other domains or sequences. Other ScFvs useful in the invention also include those with humanized binding or other domains or sequences. In such embodiments, all or a portion of an immunoglobulin binding or other sequence that is derived from a non-human source may be "humanized" according to recognized procedures for generating humanized antibodies, i.e., immunoglobulin sequences into which human Ig sequences are introduced to reduce the degree to which a human immune system would perceive such proteins as foreign.

Example of scFvs useful in the invention, whether included as murine or other scFvs (including human scFvs), chimeric scFvs, or humanized scFvs, in whole or in part, include anti-human CD20 scFvs (for example, "2H7" scFvs), anti-human CD37 scFvs (for example, "G28-1" scFvs), anti-human CD40 scFvs (for example, "G28-5" scFvs and "40.2.220" scFvs), anti-carcinoma-associated antigen scFvs (for example, "L6" scFvs), anti-CTLA-4 (CD152) scFvs (for example, "10A8" scFvs), anti-human CD28 scFvs (for example, "2E12" scFvs), anti-murine CD3 scFvs (for example, "500A2" scFvs), anti-human CD3 scFvs (for example, G19-4 scFvs), anti-murine 4-1BB scFvs (for example, "1D8" scFvs), anti-human 4-1BB scFvs (for example, "5B9" scFvs), anti-human CD45RO (for example, "UCHL-1" scFvs), and anti-human CD16 (for example, "Fc2" scFvs).

scFvs useful in the invention also include scFvs, including chimeric and humanized scFvs, having one or more amino acid substitutions. A preferred amino acid substitution is at amino acid position 11 in the variable heavy chain (the $V_H$). Such a substitution may be referred to herein as "Xxx$V_H$11Zxx". Thus, for example, where the normally occurring amino acid at position $V_H$11 is a Leucine, and a Serine amino acid residue is substituted therefore, the substitution is identified as "L $V_H$11S" or "Leu $V_H$11Ser." Other preferred embodiments of the invention include molecules containing scFvs wherein the amino acid residue normally found at position $V_H$11 is deleted. Still other preferred embodiments of the invention include molecules containing scFvs wherein the amino acid residues normally found at positions $V_H$10 and/or $V_H$11 and/or $V_H$12 are substituted or deleted.

Other binding regions within the molecules of the invention may include domains that comprise sites for glycosylation, for example, covalent attachment of carbohydrate moieties such as monosaccharides or oligosaccharides.

Still other binding regions within molecules of the invention include polypeptides that may comprise proteins or portions thereof that retain the ability to specifically bind another molecule, including an antigen. Thus, binding regions may comprise or be derived from hormones, cytokines, chemokines, and the like; cell surface or soluble receptors for such polypeptide ligands; lectins; intercellular adhesion receptors such as specific leukocyte integrins, selectins, immunoglobulin gene superfamily members, intercellular adhesion molecules (ICAM-1, -2, -3) and the like; histocompatibility antigens; and so on. Binding regions derived from such molecules generally will include thoss portions of the molecules necessary or desired for binding to a target.

Certain constructs include binding regions that comprise receptor or receptor-binding domains. Receptor domains useful for binding to a target include, for example, a CD154 extracellular domain, or a CTLA-4 extracellular domain. In another example, the binding domain may include a first portion comprising, consisting essentially or, or consisting of, a CD154 extracellular domain and a second portion comprising, consisting essentially or, or consisting of, at least one immunoglobulin variable region polypeptide, said second portion including, for example, an scFv or a $V_H$. Examples of other cell surface receptors that may comprise, consist essentially or, or consist of, or a portion of which may provide, a binding region or binding domain polypeptide, include, for example, HER1, HER2, HER3, HER4, epidermal growth factor receptor (EGFR), vascular endothelial cell growth factor, vascular endothelial cell growth factor receptor, insulin-like growth factor-I, insulin-like growth factor-II, transferrin receptor, estrogen receptor, progesterone receptor, follicle stimulating hormone receptor (FSH-R), retinoic acid receptor, MUC-1, NY-ESO-1, Melan-A/MART-1, tyrosinase, Gp-100, MAGE, BAGE, GAGE, any of the CTA class of receptors including in particular HOM-MEL-40 antigen encoded by the SSX2 gene, carcinoembyonic antigen (CEA), and PyLT. Additional cell surface receptors that may be sources of binding regions or binding domain polypeptides include, for example, CD2, 4-1BB, 4-1BB ligand, CD5, CD10, CD27, CD28, CD152/CTLA-4, CD40, interferon-γ (IFN-γ), interleukin-4 (IL-4), interleukin-17 (IL-17) and interleukin-17 receptor (IL-17R). Still other cell surface receptors that may be sources of binding regions and/or binding domain polypeptides include, for example, CD59, CD48, CD58/LFA-3, CD72, CD70, CD80/B7.1, CD86/B7.2, B7-H1/B7-DC, IL-17, CD43, ICOS, CD3 (e.g., gamma subunit, epsilon subunit, delta subunit), CD4, CD25, CD8, CD11b, CD14, CD56, CD69 and VLA-4 ($\alpha_4\beta_7$). The following cell surface receptors are typically associated with B cells: CD19, CD20, CD22, CD30, CD153 (CD30 ligand), CD37, LD50 (ICAM-3), CD106 (VCAM-1), CD54 (ICAM-1), interleukin-12, CD134 (OX40), CD137 (41BB), CD83, and DEC-205. These lists are not exhaustive. Binding regions such as those set forth above may be connected, for example, by a native or engineered IgD hinge region polypeptide, preferably a human or humanized native or engineered IgD hinge region polypeptide. The invention thus further provides constructs that comprise, consist essentially of, or consist of, two binding regions, for example, an scFv and a cell surface receptor (or portion thereof), connected by a third molecule, for example, an IgD hinge region polypeptide as described herein.

Various molecules of the invention described and claimed herein include a connecting region joining one end of the molecule to another end. Such connecting regions may comprise, for example, immunoglobulin hinge region polypeptides, including any hinge peptide or polypeptide that occurs naturally. A connecting region may also include, for example, any artificial peptide or other molecule (including, for example, non-peptide molecules, partial peptide molecules, and peptidomimetics, etc.) useful for joining the tail region and the binding region. These may include, for example, alterations of molecules situated in an immunoglobulin heavy chain polypeptide between the amino acid residues responsible for forming intrachain immunoglobulin-domain disulfide bonds in CH1 and CH2 regions. Naturally occurring hinge regions include those located between the constant region domains, CH1 and CH2, of an immunoglobulin. Useful immunoglobulin hinge region polypeptides include, for example, human immunoglobulin hinge region polypeptides and llama or other camelid immunoglobulin hinge region polypeptides. Other useful immunoglobulin hinge region polypeptides include, for example, nurse shark and spotted ratfish immunoglobulin hinge region polypeptides. Human immunoglobulin hinge region polypeptides include, for example, wild type IgG hinges including wild-type human IgG1 hinges, human IgG-derived immunoglobulin hinge region polypeptides, a portion of a human IgG hinge or IgG-derived immunoglobulin hinge region, wild-type human IgA hinge region polypeptides, human IgA-derived immunoglobulin hinge region polypeptides, a portion of a human IgA hinge region polypeptide or IgA-derived immunoglobulin hinge region polypeptide, wild-type human IgD hinge region polypeptides, human Ig-D derived immunoglobulin hinge region polypeptides, a portion of a human IgD hinge region polypeptide or IgD-derived immunoglobulin hinge region polypeptide, wild-type human IgE hinge-acting region, i.e., IgE CH2 region polypeptides (which generally have 5 cysteine residues), human IgE-derived immunoglobulin hinge region polypeptides, a portion of a human IgE hinge-acting region, i.e., IgE CH2 region polypeptide or IgE-derived immunoglobulin hinge region polypeptide, and so on. A polypeptide "derived from" or that is "a portion or fragment of" an immunoglobulin polypeptide chain region regarded as having hinge function has one or more amino acids in peptide linkage, for example 15-115 amino acids, preferably 95-110, 80-94, 60-80, or 5-65 amino acids, preferably 10-50, more preferably 15-35, still more preferably 18-32, still more preferably 20-30, still more preferably 21, 22, 23, 24, 25, 26, 27, 28 or 29 amino acids. Llama immunoglobulin hinge region polypeptides include, for example, an IgG1 llama hinge. The connecting region may comprise a stretch of consecutive amino acids from an immunoglobulin hinge region. For example, the connecting region can comprise at least five consecutive hinge region amino acids, at least ten consecutive hinge region amino acids, at least fifteen consecutive hinge region amino acids, at least 20 consecutive hinge region amino acids, and at least twenty five or more consecutive hinge region amino acids from human IgG hinge, human IgA hinge, human IgE hinge, camelid hinge region, IgG1 llama hinge region, nurse shark hinge region, and spotted ratfish hinge region, including for example an $IgG_1$ hinge region, a $IgG_2$ hinge region, a $IgG_3$ hinge region, an $IgG_3$ hinge region, and an $IgG_4$ hinge region.

Such connecting regions also include, for example, mutated or otherwise altered or engineered immunoglobulin hinge region polypeptides. A mutated or otherwise altered or engineered immunoglobulin hinge region polypeptide may comprise, consist essentially of, or consist of, a hinge region that has its origin in an immunoglobulin of a species, of an immunoglobulin isotype or class, or of an immunoglobulin subclass that is the same or different from that of any included native or engineered CH2 and CH3 domains. Mutated or otherwise altered or engineered immunoglobulin hinge region polypeptides include those derived or constructed from, for example, a wild-type immunoglobulin hinge region that contains one or more cysteine residues, for example, a wild-type human IgG or IgA hinge region that naturally comprises three cysteines. In such polypeptides the number of cysteine residues may be reduced by amino acid substitution or deletion or truncation, for example. These polypeptides include, for example, mutated human or other IgG1 or IgG4 hinge region polypeptides containing zero, one, or two cysteine residues, and mutated human or other IgA1 or IgA2 hinge region polypeptides that contain zero, one, or two cysteine residues. Mutated or otherwise altered or engineered immunoglobulin hinge region polypeptides include those derived or constructed from, for example, a wild-type immunoglobulin hinge region that contains three or more cysteine residues, for example, a wild-type human IgG2 hinge region (which has 4 cysteines) or IgG4 hinge region (which has 11 cysteines). Mutated or otherwise altered or engineered immunoglobulin hinge region polypeptides include those derived or constructed from, for example, an IgE CH2 wild-type immunoglobulin region that generally contains five cysteine residues. In such polypeptides the number of cysteine residues may be reduced by one or more cysteine residues by amino acid substitution or deletion or truncation, for example. Also included are altered hinge region polypeptides in which cysteine residues in the hinge region are substituted with serine or one or more other amino acids that are less polar, less hydrophobic, more hydrophilic, and/or neutral. Such mutated immunoglobulin hinge region polypeptides include, for example, mutated hinge region polypeptides that contain one cysteine residue and that are derived from a wild-type immunoglobulin hinge region polypeptide having two or more cysteine residues, such as a mutated human IgG or IgA hinge region polypeptide that contains one cysteine residue and that is derived from a wild-type human IgG or IgA region polypeptide. Connecting region polypeptides include immunoglobulin hinge region polypeptides that are compromised in their ability to form interchain, homodimeric disulfide bonds.

Mutated immunoglobulin hinge region polypeptides also include mutated hinge region polypeptides that exhibit a reduced ability to dimerize, relative to a wild-type human immunoglobulin G hinge region polypeptide, and mutated hinge region polypeptides that allow expression of a mixture of monomeric and dimeric molecules. Mutated immunoglobulin hinge region polypeptides also include hinge region polypeptides engineered to contain a glycosylation site. Glycosylation sites include, for example, an asparagine-linked glycosylation site, an O-linked glycosylation site, a C-mannosylation site, a glypiation site, and a phosphoglycation site.

Specific connecting regions useful in molecules of the invention described and claimed herein include, for example, the following 18 amino acid sequences, DQEPKSCDKTH-TCPPCPA (SEQ ID NO:10), DQEPKSSDKTHTSPPSPA (SEQ ID NO:18), and DLEPKSCDKTHTCPPCPA (SEQ ID NO:12). Other specific connecting regions include, for example, the mutant hinges within the sequences referred to herein as "2H7 scFv (SSS-S)H WCH2 WCH3" and "2H7 scFv (CSS)H WCH2 WCH3", and the human IgA-derived hinge referred to herein as "2H7 scFv IgAH WCH2 WCH3".

Tail regions within the molecules of the invention may include heavy chain constant region immunoglobulin sequences. Tail regions may thus include, for example, a polypeptide having at least one of an immunoglobulin heavy chain CH2 constant region polypeptide and an immunoglobulin heavy chain CH3 constant region polypeptide. At least one of the immunoglobulin heavy chain CH2 constant region polypeptide and the immunoglobulin heavy chain CH3 constant region polypeptide may be derived from a human immunoglobulin heavy chain. Thus, for example, CH2 and/or CH3 polypeptides may be derived from human IgG, human IgA, or human IgD molecules. Tail regions may also include, for example, a polypeptide having at least one of an immunoglobulin heavy chain CH3 constant region polypeptide and an immunoglobulin heavy chain CH4 constant region polypeptide. At least one of the immunoglobulin heavy chain CH3 constant region polypeptide and the immunoglobulin heavy chain CH4 constant region polypeptide may be derived from a human immunoglobulin heavy chain. Thus, for example, CH3 and/or CH4 polypeptides may be derived from human IgE. An immunoglobulin heavy chain CH2 region polypeptide included within a molecule of the invention may, for example, be from the IgG1, IgG2, IgG3 and/or IgG4 subclasses. An immunoglobulin heavy chain CH3 region polypeptide included within a molecule of the invention may also, for example, be from the IgG1, IgG2, IgG3 and/or IgG4 subclasses. Additionally, both the immunoglobulin heavy chain CH2 region polypeptide and the immunoglobulin heavy chain CH2 region polypeptide included within a molecule of the invention may, for example, be from the IgG1, IgG2, IgG3 and/or IgG4 subclasses. In other molecules of the invention at least one of the immunoglobulin heavy chain constant region polypeptides selected from a CH2 constant region polypeptide and a CH3 constant region polypeptide is a human IgA constant region polypeptide. An immunoglobulin heavy chain CH2 region polypeptide included within a molecule of the invention may, for example, be from the IgA1 and/or IgA2 subclasses. An immunoglobulin heavy chain CH3 region polypeptide included within a molecule of the invention may also, for example, be from the IgA1 and/or IgA2 subclasses. Additionally, both the immunoglobulin heavy chain CH2 region polypeptide and the immunoglobulin heavy chain CH2 region polypeptide included within a molecule of the invention may, for example, be from the IgA1 and/or IgA2 subclasses. In still other molecules of the invention, the tail region may comprise or consist essentially of a CH2 and/or CH3 constant region polypeptide comprising a polypeptide from human IgA and/or human IgE. In other embodiments, for example, the tail region within a molecule of the invention may include an immunoglobulin heavy chain CH2 and/or CH3 constant region polypeptide that is a mutated (for example, a mutated IgA CH3 constant region polypeptide that is incapable of associating with a J chain in which, for example, the IgA CH3 constant region polypeptide is of human origin). The tail region may also comprise, consist essentially of, or consist of an extracellular portion of a protein from the TNF superfamily, for example, CD154.

For molecules of the invention intended for use in humans, these regions will typically be substantially or completely human to minimize potential human immune responses against the molecules and to provide appropriate effector functions. In certain embodiments of the invention, for example, the tail region includes a human IgG1 CH3 region sequence, a wild-type IgA heavy chain constant region polypeptide sequence that is capable or incapable of associating with J chain.

In preferred embodiments of the invention, a CH1 domain is not included in the tail region of the molecule, and the carboxyl end of the binding region is joined to the amino terminus of a CH2 portion of a tail region either directly or indirectly. A binding region may be indirectly joined to a tail region, for example via a connecting region polypeptide or other connecting molecule.

The invention also includes molecules that have mutated CH2 and/or CH3 sequences within a tail region. For example, a molecule of the invention may include a mutated Fc domain that has one or more mutations introduced into the CH2, CH3 and/or CH4 domains. In certain embodiments of the invention, molecules may include an IgA CH3 constant region polypeptide such as a human IgA CH3 constant region polypeptide in which two or more residues from the C-terminus have been deleted to yield a truncated CH3 constant region polypeptide. In other embodiments of the invention, molecules include a mutated human IgA CH3 constant region polypeptide that is incapable of associating with a J chain that comprises a C-terminal deletion of either four or 18 amino acids. However, the invention need not be so limited, such that molecules containing the mutated IgA CH3 constant region polypeptide may comprise a deletion of 2, 3, 4, 5, 6, 7, 8, 9, 10, 11, 12, 13, 14, 15, 16, 17, 18, 19, 20, 21-25, 26-30 or more amino acids, so long as the fusion protein is capable of specifically binding an antigen and capable of at least one immunological activity such as ADCC, CDC or complement fixation. The invention also includes molecules containing a tail region that comprises a mutated IgA CH3 constant region polypeptide that is incapable of associating with a J chain by virtue of replacement of the penultimate cysteine, or by chemical modification of that amino acid residue, in a manner that prevents interchain disulfide bond formation.

Various molecules of the invention include, for example, a binding domain scFv-fusion protein having a binding domain polypeptide comprising, consisting essentially of, or consisting of, (a) at least one immunoglobulin light chain variable region polypeptide, (b) at least one immunoglobulin heavy chain variable region polypeptide, and at least one linker peptide that joins the polypeptide of (a) and the polypeptide of (b). Such polypeptides may, for example, be derived from human immunoglobulins or non-human immunoglobulins.

Thus, in one aspect, the invention includes a non-naturally occurring single chain protein and/or $V_H$ protein and/or $V_L$ protein, or a desired portion of any of the above, including a first polypeptide comprising a binding domain polypeptide capable of binding to a target molecule, a second polypeptide comprising a flexible or other desired linker attached to said first polypeptide, a third polypeptide comprising a tail region, for example, an N-terminally truncated immunoglobulin heavy chain constant region polypeptide (or desired portion thereof) attached to the second polypeptide. The flexible linker may comprise, consist essentially of, or consist of, an immunoglobulin hinge region or portion thereof that has been mutated or otherwise altered or engineered, for example, one that contains a number of cysteine residues that is less than the number of cysteine residues present in the wild type immunoglobulin hinge region or portion (for example, zero, one, or two cysteines in the case of IgG1 or IgG4), and wherein said non-naturally occurring single-chain protein is capable of at least one immunological activity, for example, ADCC, CDC, and/or complement fixation. The single chain protein may be capable of two immunological activities including, for example, ADCC, CDC, and/or complement fixation. This protein may include a binding domain polypeptide that is a single chain Fv. Additionally, this protein may include a binding domain polypeptide that is a single chain Fv wherein the heavy chain variable region of the single chain Fv has an amino acid deletion or substitution at one or more of amino acid positions 9, 10, 11, 12, 108, 110, and 112. The protein may also include a binding domain polypeptide that is a single chain Fv wherein the light chain variable region of the single chain Fv has an amino acid deletion or substitution at one or more of amino acid positions 12, 80, 81, 83, 105, 106, and 107.

In another aspect, the invention includes a non-naturally occurring $V_H$ protein, or a desired portion thereof, that comprises, consists essentially of, or consists of, alone or in combination with any other molecule or construct, a $V_H$ region or portion thereof that has an amino acid deletion or substitution at one or more of amino acid positions 9, 10, 11, 12, 108, 110, and 112 of said $V_H$ region. Amino acids may be substituted with either naturally occurring or non-naturally occurring amino acids, or any other desired useful molecule.

Also described and claimed are uses of $V_H$ proteins, or desired portions thereof, that comprise, consist essentially of, or consist of, alone or in combination with any other molecule or construct, a $V_H$ region or portion thereof that has an amino acid deletion or substitution at one or more of amino acid positions 9, 10, 11, 12, 108, 110, and 112 of said $V_H$ region. Such uses include uses in phage display, yeast display, and ribosome display systems and methods.

In yet another aspect, the invention includes a non-naturally occurring $V_L$ protein, or a desired portion thereof, that comprises, consists essentially of, or consists of, alone or in combination with any other molecule, a $V_L$ region or portion thereof that has an amino acid deletion or substitution at one or more of amino acid positions 12, 80, 81, 83, 105, 106, and 107 of said $V_L$ region. Amino acids may be substituted with either naturally occurring or non-naturally occurring amino acids, or any other desired useful molecule.

Also described and claimed are uses of $V_L$ proteins, or desired portions thereof, that comprises, consists essentially of, or consists of, alone or in combination with any other molecule, a $V_L$ region or portion thereof that has an amino acid deletion or substitution at one or more of amino acid positions 12, 80, 81, 83, 105, 106, and 107 of said $V_L$ region. Such uses include uses in phage display, yeast display, and ribosome display systems and methods.

In yet another aspect, the invention includes a molecule comprising, consisting essentially of, or consisting of, (1) a $V_H$ protein, or a desired portion thereof, wherein the $V_H$ protein or portion thereof has an amino acid deletion or substitution at one or more of amino acid positions 9, 10, 11, 12, 108, 110, and 112, and (2) a non-naturally occurring $V_L$ protein, or a desired portion thereof, alone or in combination with any other molecule, wherein the $V_L$ protein or portion thereof has an amino acid deletion or substitution at one or more of amino acid positions 12, 80, 81, 83, 105, 106, and 107. Amino acids may be substituted with either naturally occurring or non-naturally occurring amino acids, or any other desired useful molecule.

Also described and claimed are uses of a molecule comprising, consisting essentially of, or consisting of, (1) a $V_H$ protein, or a desired portion thereof, wherein the $V_H$ protein or portion thereof has an amino acid deletion or substitution at one or more of amino acid positions 9, 10, 11, 12, 108, 110, and 112, and (2) a non-naturally occurring $V_L$ protein, or a desired portion thereof, alone or in combination with any other molecule, wherein the $V_L$ protein or portion thereof has an amino acid deletion or substitution at one or more of amino acid positions 12, 80, 81, 83, 105, 106, and 107. Such uses include uses in phage display, yeast display, and ribosome display systems and methods.

The invention also includes molecular constructs wherein the binding domain is a single chain Fv and the heavy chain variable region of said single chain Fv has an amino acid substitution at amino acid position 11. The amino acid substituted for the amino acid at position of 11 of the single chain Fv heavy chain variable region may be selected from the group consisting of serine, threonine, tyrosine, asparagine, glutamine, aspartic acid, glutamic acid, lysine, arginine, and histidine. The invention thus includes, for example, a construct wherein the binding domain is a single chain Fv and the heavy chain variable region of said single chain Fv has a serine amino acid substitution at amino acid position 11. Other amino acid position changes, substitutions, and deletions, are noted herein.

The invention also includes, for example, a construct wherein the binding domain is a single chain Fv and the amino acid at position 10 and/or 11 of the heavy chain variable region of said single chain Fv has been deleted.

In another aspect, the invention includes constructs wherein the binding region binds to a tumor or tumor-associated antigen. The binding region of a construct of the invention may bind, for example, to a cancer cell antigen. Cancer cell antigens to which constructs of the invention bind include cancer cell surface antigens and intracellular cancer cell antigens.

In yet another aspect, the invention includes a construct wherein the binding region binds to an antigen on an immune effector cell.

In another aspect, the invention includes a construct wherein the binding region binds to a B cell antigen including, for example, a B cell antigen selected from the group consisting of CD19, CD20, CD22, CD37, CD40, CD80, and CD86. Constructs of the invention that bind to such B cell antigens include, for example, binding regions comprising an single chain Fv. Examples of such single chain Fv binding regions include molecules comprising or consisting essentially of single chain Fvs selected from the group consisting of HD37 single chain Fv, 2H7 single chain Fv, G28-1 single chain Fv, and 4.4.220 single chain Fv. Other examples include a binding region comprising, consisting essentially of, or consisting of, an extracellular domain of CTLA-4.

In another aspect, the invention includes a construct wherein the binding region binds to a B cell differentiation antigen. B cell differentiation antigens include, for example, CD19, CD20, CD21, CD22, CD23, CD37, CD40, CD45RO, CD80, CD86, and HLA class II.

In another aspect, the invention includes a construct wherein the binding region binds to a target selected from the group consisting of CD2, CD3, CD4, CD5, CD6, CD8, CD10, CD11b, CD14, CD19, CD20, CD21, CD22, CD23, CD24, CD25, CD28, CD30, CD37, CD40, CD43, CD50 (ICAM3), CD54 (ICAM1), CD56, CD69, CD80, CD86, CD134 (OX40), CD137 (41BB), CD152 (CTLA-4), CD153 (CD30 ligand), CD154 (CD40 ligand), ICOS, L6, B7-H1, and HLA class II.

The invention also includes protein constructs having a binding region, a tail region, and a connecting region, wherein the protein construct is capable of existing in solution as a monomer or in substantially monomeric form.

The invention also includes protein constructs having a binding region, a tail region, and a connecting region, wherein the protein construct is capable of forming a complex comprising two or more of said protein constructs including, for example, wherein said complex is a dimer.

In another aspect, constructs of the invention are capable of participating in or inducing or eliciting or helping to induce or elicit, directly or indirectly, at least one immunological activity selected from the group consisting of antibody dependent cell-mediated cytotoxicity, complement-dependent cytotoxicity (or complement-mediated lysis), complement fixation, induction of apoptosis, induction of one or more biologically active signals, induction of one or more immune effector cells, activation of cellular differentiation, cellular activation, release of one or more biologically active molecules, and neutralization of an infectious agent or toxin.

In another aspect, binding constructs of the invention are capable of induction of biologically active signals by activation or inhibition of one or more molecules selected from the group consisting of protein kinases, protein phosphatases, G-proteins, cyclic nucleotides or other second messengers, ion channels, and secretory pathway components. Such biologically active molecules are, for example, proteases. Other biologically active molecules are, for example, cytokines, including by way of example monokines, lymphokines, chemokines, growth factors, colony stimulating factors, interferons, and interleukins.

In another aspect, constructs of the invention are capable of induction, or participation in the induction, of one or more immune effector cells selected from the group consisting of NK cells, monocytes, macrophages, B cells, T cells, mast cells, neutrophils, eosinophils, and basophils.

In another aspect, constructs of the invention are capable of induction, or participation in the induction, of one or more immune effector cells that results in antibody dependent cell-mediated cytotoxicity or the release of one or more biologically active molecules.

In another aspect, constructs of the invention are capable of participating in and/or initiating apopotosis within target cells, for example, by activating one or more signalling mechanisms or molecules.

In another aspect, constructs of the invention are capable of induction, or participation in the induction, of cellular activation, wherein said activation leads to changes in cellular transcriptional activity. In one embodiment, cellular transcriptional activity is increased. In another embodiment, cellular transcriptional activity is decreased.

In another aspect, constructs of the invention having tail regions comprising, consisting essentially of, or consisting of, constant regions from IgA or IgE molecules, are capable of induction, or participation in the induction, of degranulation of neutrophils and/or mast cells.

In another aspect, constructs of the invention are capable of promotion, or participation in the promotion, of neutralization of an infectious agent, wherein said infectious agent is, for example, a bacterium, a virus, a parasite, or a fungus.

In another aspect, constructs of the invention are capable of promoting, or participating in the promotion of, neutralization of a toxin, wherein said toxin is selected from the group consisting of endotoxins and exotoxins. Such toxins include, for example, exotoxins selected from the group consisting of anthrax toxin, cholera toxin, diphtheria toxin, pertussis toxin, *E. coli* heat-labile toxin LT, *E. coli* heat stable toxin ST, shiga toxin *Pseudomonas* Exotoxin A, botulinum toxin, tetanus toxin, *Bordetella pertussis* AC toxin, and *Bacillus anthracis* EF toxin. Other toxins include, for example, saxitoxins, tetrodotoxin, mushroom toxins (amatoxins, gyromitrin, orellanine, etc.), aflatoxins, pyrrolizidine alkaloids, phytohemagglutinins, and grayanotoxins.

In another aspect, constructs of the invention are capable of binding to an intracellular target to, for example, effect (or participate in effecting) a cellular function. Such constructs include, for example, constructs that include a tail region comprising, consisting essentially of, or consisting of, a native or engineered IgA CH2 domain region and a native or engineered IgA CH3 domain region, said tail region being capapble of binding J chain. Such a tail region is found, for example, in the 2H7 scFv IgAH WlgACH2 WCH3+JChain construct. Thus, the invention includes constructs having, for example, an "Anti-Intracellular Target" binding domain (for example, and "Anti-Intracellular Target" scFv), a connecting region, and a native or engineered IgA constant region capable of binding J chain (for example, WlgACH2 WCH3).

In still another aspect, constructs of the invention include a molecule wherein an N-terminally immunoglobulin heavy chain constant region polypeptide comprises an IgG CH2 constant region polypeptide attached to an immunoglobulin heavy chain IgG CH3 constant region polypeptide.

In yet another aspect, the invention includes a method of reducing a target cell population in a subject comprising administering to said subject a therapeutically effective amount of a protein molecule that is less than about 120 kK, or less than about 150 kD, as measured, for example, by HPLC and non-reducing gels and consists essentially of (a) a first protein or peptide molecule that is capable of binding to cells within said target cell population, and (b) a second protein or peptide molecule that is capable of (i) binding to an Fc receptor and/or (ii) inducing target cell apoptosis, and/or (iii) fixing complement, wherein said first protein or peptide molecule is directly connected to said second protein or peptide molecule, or, optionally, said first protein or peptide molecule and said second protein or peptide molecule are linked by a third protein or peptide molecule, wherein said protein molecule is not an antibody, a member of the TNF family or the TNF receptor family, and is not conjugated with a bacterial toxin, a cytotoxic drug, or a radioisotope.

In another aspect, the invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of at least one immunological activity, and provided that (a) when the connecting region polypeptide comprises an IgG hinge region polypeptide having no cysteine residues, the binding domain polypeptide target is not CD20 or L6, or (b) when the connecting region polypeptide comprises an IgG hinge region polypeptide having no cysteine residues, the single chain protein is not a 1F5 scFv capable of binding to CD20. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of binding to a target molecule on or in a target cell and decreasing the number of target cells in vivo and/or depleting a population of target cells in vivo. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of inducing antibody-dependent cell-mediated cytotoxicity and complement fixation. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of (1) inducing antibody-dependent cell-mediated cytotoxicity and complement fixation, and (2) binding to a target molecule on or in a target cell and decreasing the number of target cells in vivo and/or depleting a population of target cells in vivo. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of at least one immunological activity. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of inducing at least one immunological activity selected from (a) antibody-dependent cell-mediated cytotoxicity and (b) complement fixation. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of antibody-dependent cell-mediated cytotoxicity and complement fixation. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of binding to a target molecule on or in a target cell and decreasing the number of target cells in vivo and/or depleting a population of target cells in vivo. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of inducing at least one immunological activity selected from antibody-dependent cell-mediated cytotoxicity and complement fixation, and wherein said single-chain protein is capable of binding to a target molecule on or in a target cell and decreasing the number of target cells in vivo and/or depleting a population of target cells in vivo. The invention also includes single chain proteins comprising, consisting essentially of, or consisting of, (i) a first polypeptide having a binding domain polypeptide capable of binding to a target molecule; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein when said connecting region comprises an IgG hinge region polypeptide having at least first, second, and third cysteine residues, said first cysteine being N-terminal to said second cysteine and said second cysteine being N-terminal to said third cysteine, one or both of said second and third cysteine residues is substituted or deleted, and wherein said single-chain protein is capable of inducing antibody-dependent cell-mediated cytotoxicity and complement fixation, and wherein said single-chain protein is capable of binding to a target molecule on or in a target cell and decreasing the number of target cells in vivo and/or depleting a population of target cells in vivo. The invention also includes single chain proteins comprising, consisting essentially of, or consisting of, (i) a first polypeptide having a binding domain polypeptide capable of binding to a target molecule, said binding domain polypeptide comprising a heavy chain variable region wherein leucine at position 11 in the first framework region of the heavy chain variable region is deleted or substituted with another amino acid; (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of at least one immunological activity, and provided that when the binding domain polypeptide is capable of binding to CD20 said connecting region comprises three cysteine residues wherein one or two of said three cysteine residues is substituted or replaced with another amino acid. The invention also includes single chain proteins comprising, consisting essentially of, or consisting of, (i) a first polypeptide having a binding domain polypeptide capable of binding to a target molecule, said binding domain polypeptide comprising a heavy chain variable region wherein leucine at position 11 in the first framework region of the heavy chain variable region is deleted or substituted with another amino acid, (ii) a second polypeptide comprising a connecting region attached to the C-terminus of said first polypeptide; and (iii) a third polypeptide comprising an N-terminally truncated immunoglobulin heavy chain constant region polypeptide attached to the C-terminus of said second polypeptide, wherein said single-chain protein is capable of inducing at least one immunological activity, provided that when binding domain polypeptide is a 2H7 scFv capable of binding to CD20 and said connecting region comprises an IgG hinge region polypeptide having at least first, second, and third cysteine residues, said first cysteine being N-terminal to said second cysteine and said second cysteine being N-terminal to said third cysteine, one or two of said cysteine residues is substituted or deleted. The invention also includes single chain proteins comprising, consisting essentially of, or consisting of, (i) a first polypeptide having a binding domain polypeptide capable of binding to a target molecule on or in a target cell, said binding domain polypeptide comprising a heavy chain variable region wherein leucine at position 11 in the first framework region of the heavy chain variable region is deleted or substituted with another amino acid; (ii) a second polypeptide comprising a connecting region attached to said first polypeptide; and (iii) a third polypeptide comprising an N-terminally truncated immunoglobulin heavy chain constant region polypeptide attached to the second polypeptide, wherein said single-chain protein is capable of at least one immunological activity, provided that said single chain protein does not comprise, or consist essentially of, a binding domain polypeptide capable of binding to CD20 and a connecting region that comprises (a) an IgG hinge having three cysteine residues or (b) an IgG hinge comprising three serine (or like amino acid) residues that have been substituted for cysteine residues. There are many possible variations and variants of these single chain proteins. For example, the binding domain polypeptide may be a single chain antibody or scFv including naturally occurring and/or non-naturally occurring $V_H$ and $V_L$ polypeptides, and the binding domain polypeptide may bind any of a number of targets. Non-naturally occurring $V_H$ polypeptides include, by way of example and not limitation, human heavy chain variable region polypeptide comprising a mutation, substitution, or deletion of an amino acid(s) at a location corresponding to any one or more of amino acid positions 9, 10, 11, 12, 108, 110, and/or 112. Non-naturally occurring $V_L$ polypeptides include, by way of example and not limitation, human light chain variable region polypeptides comprising a mutation, substitution, or deletion of an amino acid(s) at a location corresponding to any one or more of amino acid positions 12, 80, 81, 83, 105, 106, and 107. Targets include, by way of example and not limitation, CD19, CD20, CD28, CD30, CD37, CD40, L6, HER2, epidermal growth factor receptors (EGFRs), vascular endothelial cell growth factors (VEGFs), tumor necrosis factors (e.g., TNF-alpha), as well as other targets described or referred to herein or otherwise useful, whether now known or later discovered. Additionally, the connecting region polypeptide may be any of a number of molecules, both naturally occurring and non-naturally occurring. Connecting region polypeptides include, by way of example and not limitation, naturally occurring and non-naturally occurring immunoglobulin hinge region polypeptides. Naturally occurring immunoglobulin hinge region polypeptides include wild-type immunoglobulin hinge region polypeptides such as, by way of example and not limitation, human IgG1 hinge region polypeptides, human IgA hinge region polypeptides, human IgD hinge region polypeptides, human IgE hinge-acting regions (e.g., IgE CH2), camelid immunoglobulin hinge regions, or any other naturally occurring hinge region peptides described or referred to herein or otherwise useful useful, whether now known or later discovered. Non-naturally occurring immunoglobulin hinge region polypeptides include, by way of example and not limitation, mutated naturally occurring immunoglobulin hinges, including immunoglobulin hinge region polypeptides that contain less than the wild-type number of cysteines, for example, mutated naturally occurring immunoglobulin hinge region polypeptides that contain zero, one, or two cysteines, and any other connecting region molecule described or referenced herein or otherwise useful or now known or later discovered as useful for connecting joining, for example, immunoglobulin domains such as a CH1 domain and a CH2 domain. N-terminally truncated immunoglobulin heavy chain constant region polypeptides include naturally occurring and non-naturally occurring N-terminally truncated immunoglobulin heavy chain constant region polypeptides that, with or without other portions of the single chain protein, provide one or more effector functions such as those described herein. Naturally occurring N-terminally truncated immunoglobulin heavy chain constant region polypeptides include, by way of example and not limitation, CH2CH3 constant region polypeptides, including CH2CH3 constant region polypeptides taken, separately or together, from human IgGs, human IgAs, and human IgE, and any other immunoglobulin heavy chain constant region polypeptide described or referenced herein or otherwise now known or later discovered to be useful. Non-naturally occurring N-terminally truncated immunoglobulin heavy chain constant region polypeptides include, by way of example and not limitation, any mutated naturally occurring heavy chain constant region polypeptide described or referred to herein or otherwise now known or later discovered to be useful.

Various specific constructs of the invention include, by way of example only, the following:
1. 2H7 scFv VH L11S (CSC-S) H WCH2 WCH3
2. 2H7 scFv VH L11S IgE CH2 CH3 CH4
3. 2H7 scFv VH L11S mIgE CH2 CH3 CH4
4. 2H7 scFv VH L11S mIgAH WIgACH2 T4-CH3
5. 2H7 scFv VH L11S (SSS-S) H K322S CH2 WCH3
6. 2H7 scFv VH L11S (CSS-S) H K322S CH2 WCH3
7. 2H7 scFv VH L11S (SSS-S) H P331S CH2 WCH3
8. 2HU scFv VH L11S (CSS-S) H P331S CH2 WCH3
9. 2H7 scFv VH L11S (SSS-S) H T256N CH2 WCH3
10. 2H7 scFv VH L11S (SSS-S) H RTPE/QNAK (255-258) CH2 WCH3
11. 2H7 scFv VH L11S (SSS-S) H K290Q CH2 WCH3
12. 2H7 scFv VH L11S (SSS-S) H A339P CH2 WCH3
13. G28-1 scFv (SSS-S) H WCH2 WCH3
14. G28-1 scFv IgAH WCH2 WCH3
15. G28-1 scFv VH L11S (SSS-S) H WCH2 WCH3

16. G28-1 scFv VH L11S (CSS-S) H WCH2 WCH3
17. G28-1 scFv VH L11S(CSC-S) H WCH2 WCH3
18. G28-1 scFv VH L11S (SSC-P) H WCH2 WCH3
19. CTLA4 (SSS-S) H P238SCH2 WCH32
20. CTLA4 (CCC-P) WH WCH2 WCH3
21. FC2-2 scFv (SSS-S) H WCH2 WCH3
22. FC2-2 scFv VHL11S (SSS-S) H WCH2 WCH3
23. UCHL-1 scFv (SSS-S) H WCH2 WCH3
24. UCHL-1 scFv VHL11S (SSS-S) H WCH2 WCH3
25. 5B9 scFv (SSS-S) H WCH2 WCH3
26. 5B9 scFv VHL11S (SSS-S) H WCH2 WCH3
27. 2H7 scFv (SSS-S) H WCH2 WCH3
28. 2H7 scFv (SSS-S) H P238SCH2 WCH3
29. 2H7 scFv IgAH WCH2 WCH3
30. 2H7 scFv IgAH WIgACH2 T4-CH3
31. 2H7 scFv IgAH WIgACH2 WCH3+JChain
32. 2H7 scFv (CCC-P) WH WCH2 WCH3
33. 2H7 scFv (SSS-S) H WCH2 F405YCH3
34. 2H7 scFv (SSS-S) H WCH2 F405ACH3
35. 2H7 scFv (SSS-S) H WCH2 Y407ACH3
36. 2H4 scFv (SSS-S) HWCH2 F405A, Y407ACH3
37. 2H7 scFv (CSS-S) H WCH2 WCH3
38. 2H7 scFv (SCS-S) H WCH2 WCH3
39. 2H7 scFv (SSC-P) H WCH2 WCH3
40. 2H7 scFv (CSC-S) H WCH2 WCH3
41. 2H7 scFv (CCS-P) H WCH2 WCH3
42. 2H7 scFv (SCC-P) H WCH2 WCH3
43. 2H7 scFv VH L11S (SSS-S) H WCH2 WCH3
44. 2H7 scFv VH L11S (CSS-S) H WCH2 WCH3
45. G28-1 scFv VH L11S (SCS-S) H WCH2 WCH3
46. G28-1 scFv VH L11S(CCS-P) H WCH2 WCH3
47. G28-1 scFv VH L11S (SCC-P) H WCH2 WCH3
48. G28-1 scFv VH L11S mIgE CH2 CH3 CH4
49. G28-1 scFv VH L11S mIgAH WIgACH2 T4CH3
50. G28-1 scFv VH L11S hIgE CH2 CH3 CH4
51. G28-1 scFv VH L11S hIgAH WIgACH2 T4CH3
52. HD37 scFv IgAH WCH2 WCH3
53. HD37 scFv (SSS-S) H WCH2 WCH3
54. HD37 scFv VH L11S (SSS-S) H WCH2 WCH3
55. L6 scFv IgAH WCH2 WCH3
56. L6 scFv VHL11S (SSS-S) H WCH2 WCH3
57. 2H7 scFv-llama IgG1
58. 2H7 scFv-llama IgG2
59. 2H7 scFv-llama IgG3
60. CD16-6 low (ED)(SSS-S) H P238SCH2 WCH3
61. CD16-9 high (ED)(SSS-S) H P238SCH2 WCH3
62. 2e12 scFv (SSS-s)H P238SCH2 WCH3-hCD80TM/CT
63. 10A8 scFv (SSS-s)H P238SCH2 WCH3-hCD80TM/CT
64. 40.2.36 scFv (SSS-s)H P238SCH2 WCH3-hCD80TM/CT
65. 2H7 scFv (SSS-s)H P238SCH2 WCH3-hCD80TM/CT
66. G19-4 scFv (SSS-s)H P238SCH2 WCH3-hCD80TM/CT
67. 2e12 scFv (SSS-s)H WCH2 WCH3-hCD80TM/CT
68. 2e12 scFv IgAH IgACH2 T4CH3-hCD80TM/CT
69. 2e12 scFv IgE CH2CH3CH4-hCD80TM/CT
70. 2e12 scFv (SSS-s)H P238SCH2 WCH3-mFADD-TM/CT
71. 2e12 scFv (SSS-s)H WCH2 WCH3-mFADD-TM/CT
72. 2e12 scFv (SSS-s)H WCH2 WCH3-mcasp3-TM/CT
73. 2e12 scFv (SSS-s)H P238SCH2 WCH3-mcasp3-TM/CT
74. 2e12 scFv (SSS-s)H WCH2 WCH3-mcasp8-TM/CT
75. 2e12 scFv (SSS-s)H P238SCH2 WCH3-mcasp-8-TM/CT
76. 2e12 scFv (SSS-s)H WCH2 WCH3-hcasp3-TM/CT
77. 2e12 scFv (SSS-s)H P238SCH2 WCH3-hcasp3-TM/CT
78. 2e12 scFv (SSS-s)H WCH2 WCH3-hcasp8-TM/CT
79. 2e12 scFv (SSS-s)H P238SCH2 WCH3-hcasp8-TM/CT
80. 1D8 scFv-hIgG1 (SSS-s)H P238SCH2 WCH3-hCD80TM/CT
81. 1D8 scFv-hIgG1 (SSS-s)H WCH2 WCH3-hCD80TM/CT
82. 1D8 scFv-mIgAT4-hCD80TM/CT
83. 1D8 scFv-hIgE-hCD80TM/CT
84. 1D8 scFv-hIgG1 (SSS-s)H P238SCH2 WCH3-mFADD-TM/CT
85. 1D8 scFv-hIgG1 (SSS-s)H WCH2 WCH3-mFADD-TM/CT
86. 1D8 scFv-hIgG1 (SSS-s)H WCH2 WCH3-mcasp3-TM/CT
87. 1D8 scFv-hIgG1 (SSS-s)H P238SCH2 WCH3-mcasp3-TM/CT
88. 1D8 scFv-hIgG1 (SSS-s)H WCH2 WCH3-mcasp8-TM/CT
89. 1D8 scFv-hIgG1 (SSS-s)H P238SCH2 WCH3-mcasp8-TM/CT
90. 1D8 scFv-hIgG1 (SSS-s)H WCH2 WCH3-hcasp3-TM/CT
91. 1D8 scFv-hIgG1 (SSS-s)H P238SCH2 WCH3-hcasp3-TM/CT
92. 1D8 scFv-hIgG1 (SSS-s)H WCH2 WCH3-hcasp8-TM/CT
93. 1D8 scFv-hIgG1 (SSS-s)H P238SCH2 WCH3-hcasp8-TM/CT L6 scFv (SSS-S) H WCH2 WCH3
94. 2H7 scFv CD154 (L2)
95. 2H7 scFv CD154 (S4)
96. CTLA4 IgAH IGACH2CH3
97. CTLA4 IgAH IgACH2 T4CH3
98. 2H7 scFv IgAH IgACH2CH3
99. 2H7 scFv IgAH IgAHCH2 T18CH3
100. 2H&-40.2.220 scFv (SSS-S) H WCH2 WCH3 (bispecific anti-ccd20-anti-cd40)
101. 2H7 scFv IgAH IgACH2 T4CH3-hCD89 TM/CT
102. G19-4 scFv (CCC-P) WH WCH2 WCH3-hCD89 TM/CT
103. 2e12 scFv (CCC-P) WH WCH2 WCH3-hCD89 TM/CT These and other aspects of the present invention will become further apparent upon reference to the following detailed description and attached drawings. As noted herein, all referenced patents, articles, documents, and other materials disclosed or identified herein are hereby incorporated by reference in their entireties as if each was incorporated individually.

BRIEF DESCRIPTION OF THE DRAWINGS

FIG. 1 shows DNA and deduced amino acid sequences [SEQ ID NOS:688 and 689] of 2H7 scFv-Ig, a binding domain-immunoglobulin fusion protein capable of specifically binding CD20.

FIG. 4 shows complement fixation (FIG. 4A) and mediation of antibody-dependent cellular cytotoxicity (FIG. 4B) by 2H7scFv-Ig.

FIG. 7 shows DNA and deduced amino acid sequences of 2H7scFv-CD154 L2 (FIG. 7A, SEQ ID NOS:690 and 691) and 2H7scFv-CD154 S4 (FIG. 7B, SEQ ID NOS:692 and 693) binding domain-immunoglobulin fusion proteins capable of specifically binding CD20 and CD40.

FIG. 16 shows effects of CytoxB-MHWTG1C on levels of circulating CD40+B cells in macaque blood samples.

FIG. 19 shows antibody dependent cell-mediated cytotoxicity activity of binding domain-immunoglobulin fusion proteins 2H7 ScFv-Ig, HD37 ScFv-Ig and G28-1 (CD37-specific) ScFv-Ig.

FIG. 23 presents a sequence alignment of immunoglobulin hinge and CH2 domains of human IgG1 (SEQ ID NO:684) with the hinge and CH2 domains of llama IgG1 (SEQ ID NO:685), IgG2 (SEQ ID NO:686), and IgG3 (SEQ ID NO:687).

SEQ ID NO:55)), which was fused to human CD80 transmembrane and cytoplasmic tail domains. The data represent the average of quadruplicate samples.

FIG. 31 lists immunoglobulin constant region constructs that were used in experiments illustrated in subsequent figures.

Figure 32:
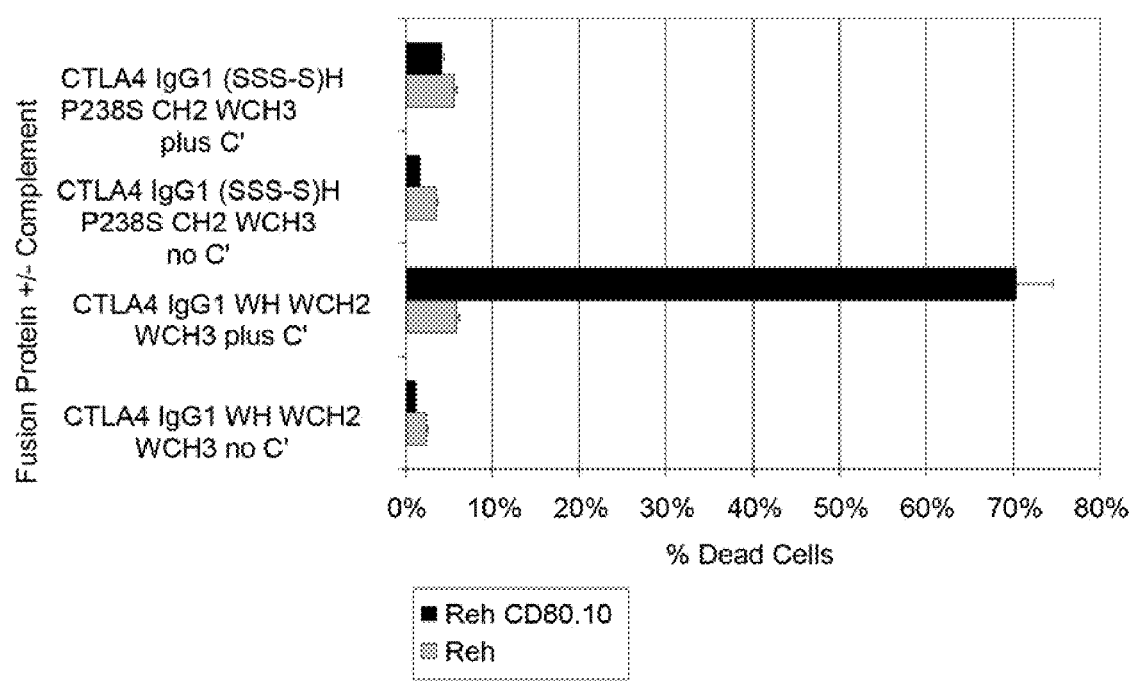

FIG. 32 depicts complement dependent cytotoxicity activity of CTLA-4 Ig fusion proteins, CTLA-4 IgG WTH (CCC) WTCH2CH3 (SEQ ID NO:_) (2 μg/ml) and CTLA-4 IgG MTH MTCH2WTCH3 (SEQ ID NO:_) (2 μg/ml), in the presence and absence of rabbit complement (plus C' and no C', respectively). The target cells were Reh cells and Reh cells transfected with CD80 (Reh CD80.10).

Figure 33:
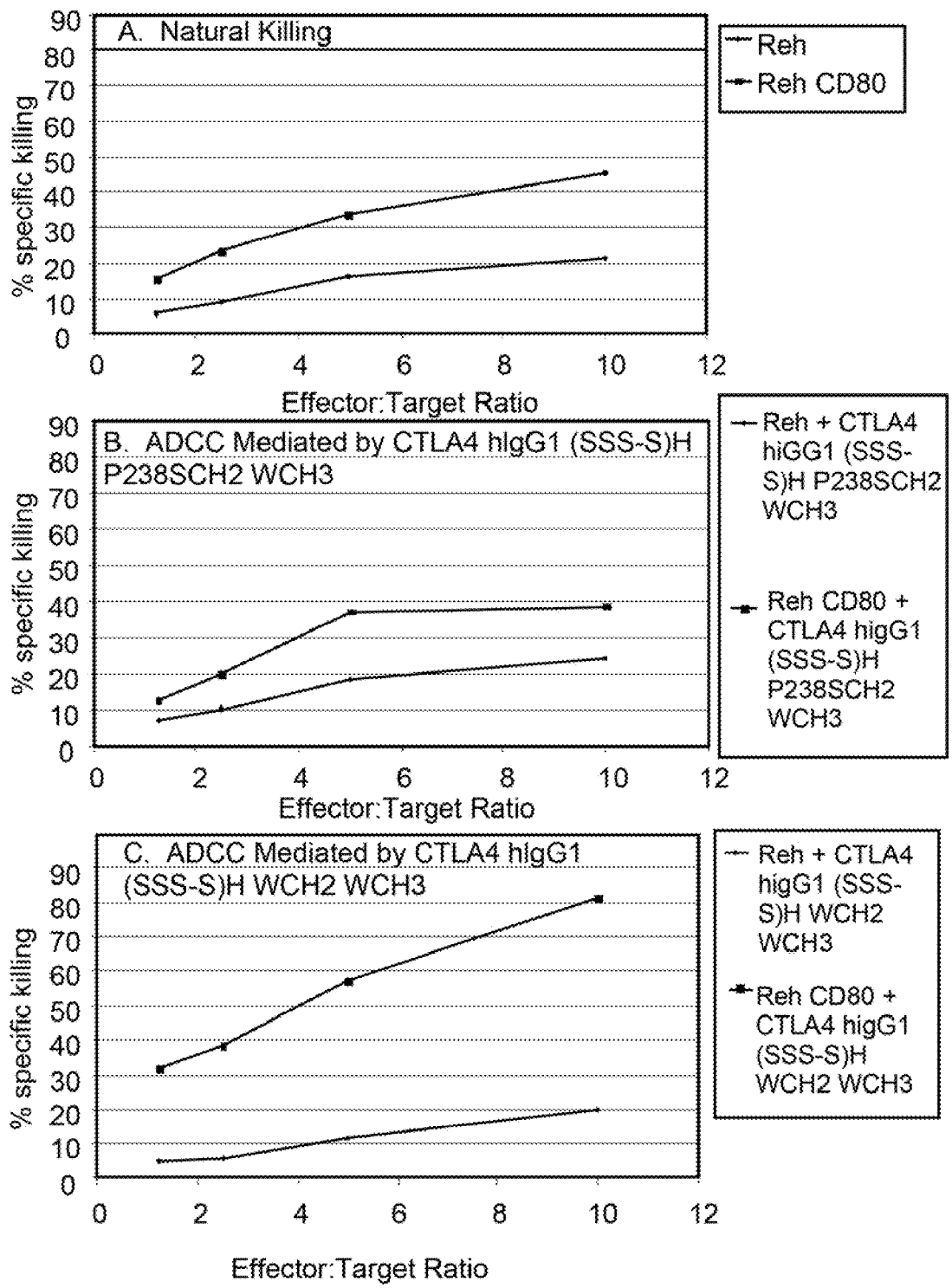

FIG. 33 shows antibody dependent cell-mediated cytotoxicity activity of CTLA-4 Ig fusion proteins, CTLA-4 IgG WTH (CCC) WTCH2CH3 (SEQ ID NO:78) (2 μg/ml) and CTLA-4 IgG MTH MTCH2WTCH3 (SEQ ID NOS:530 and 86) (2 μg/ml). Effector cells, human PBMC, were added to target cells, Reh or Reh CD80.1, at the ratios indicated. FIG. 33A presents the level of natural killing in Reh CD80.1 cells in the absence of any Ig fusion protein. FIG. 33B presents antibody dependent cell-mediated cytotoxicity mediated by CTLA-4 IgG MTH MTCH2WTCH3, and FIG. 33C presents antibody dependent cell-mediated cytotoxicity mediated by CTLA-4 IgG WTH (CCC) WTCH2CH3. Each data point represents the average percent specific killing measured in four sample wells.

Figure 34:
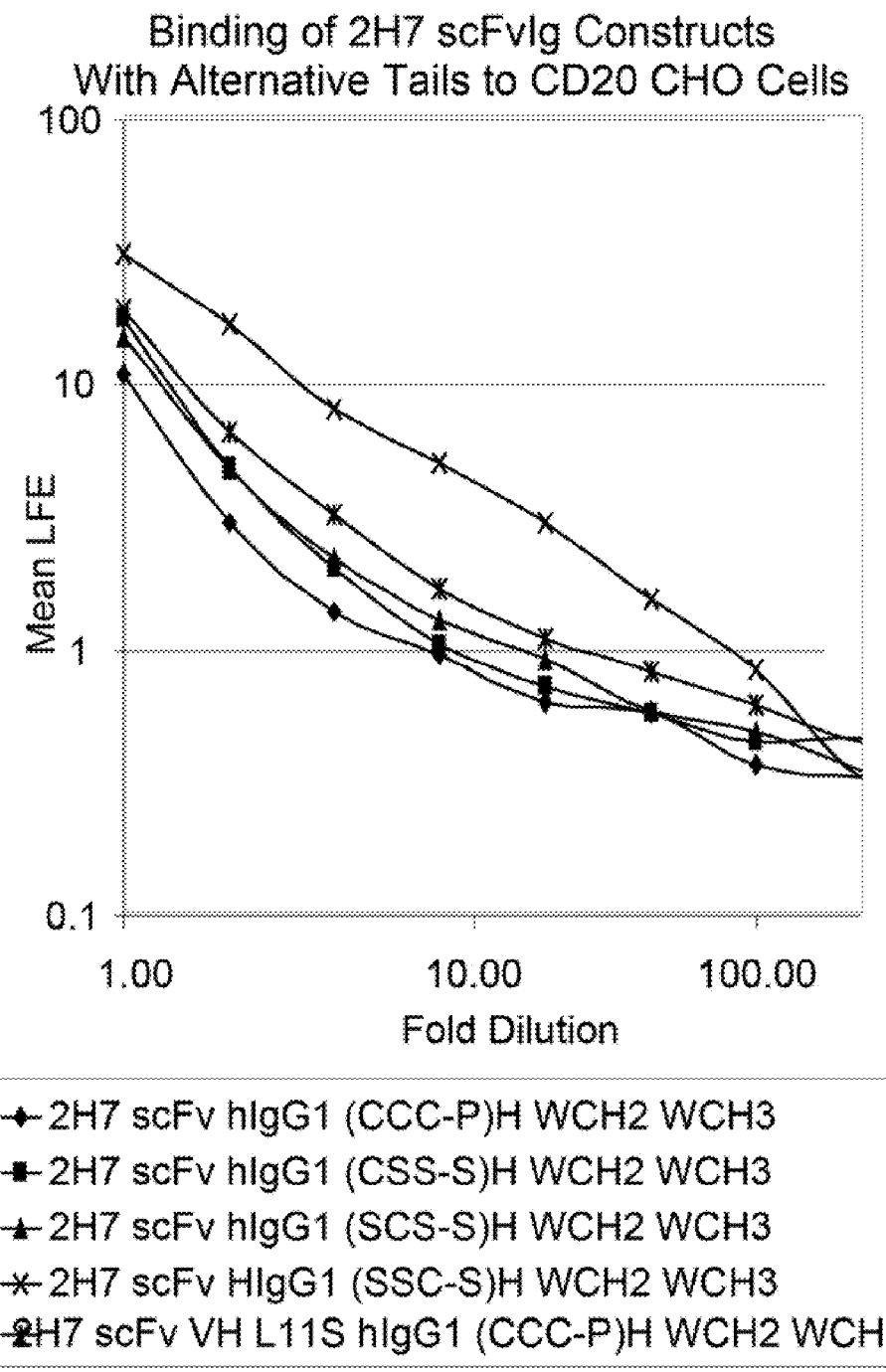

FIG. 34 illustrates binding of 2H7 (anti-CD20) scFv Ig fusion proteins to (CD20+) CHO cells by flow immunocytofluorimetry.

Figure 35:
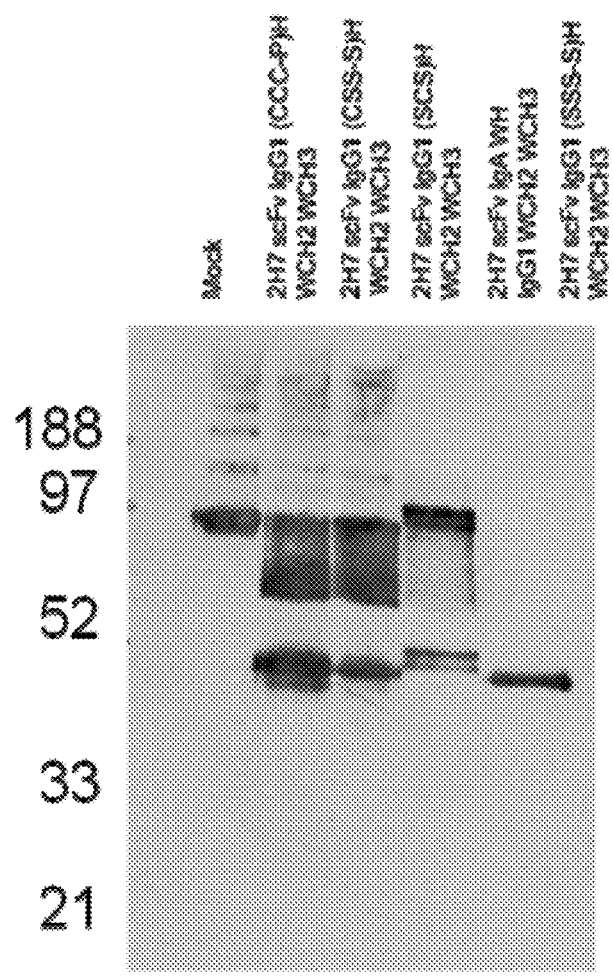

FIG. 35 presents an immunoblot of 2H7 scFv IgG and IgA fusion proteins. COS cells were transiently transfected with various 2H7 scFv Ig fusion protein constructs. The expressed polypeptides were immune precipitated with protein A, separated in a non-reducing SDS polyacrylamide gel, and then transferred to a polyvinyl fluoride membrane. Proteins were detected using an anti-human IgG (Fc specific) horseradish peroxidase conjugate. Lane 1: vector only; lane 2: 2H7 scFv IgG WTH (CCC) WTCH2CH3 (SEQ ID NO:28); lane 3: 2H7 scFv IgG MTH (CSS) WTCH2CH3 (SEQ ID NO:135); lane 4: 2H7 scFv IgG MTH (SCS) WTCH2CH3 (SEQ ID NO:137); lane 5: 2H7 scFv IgAH IgG WTCH2CH3 (SEQ ID NO:60); and lane 6: 2H7 scFv IgG MTH (SSS) WTCH2CH3 (SEQ ID NO:50).

Figure 36:
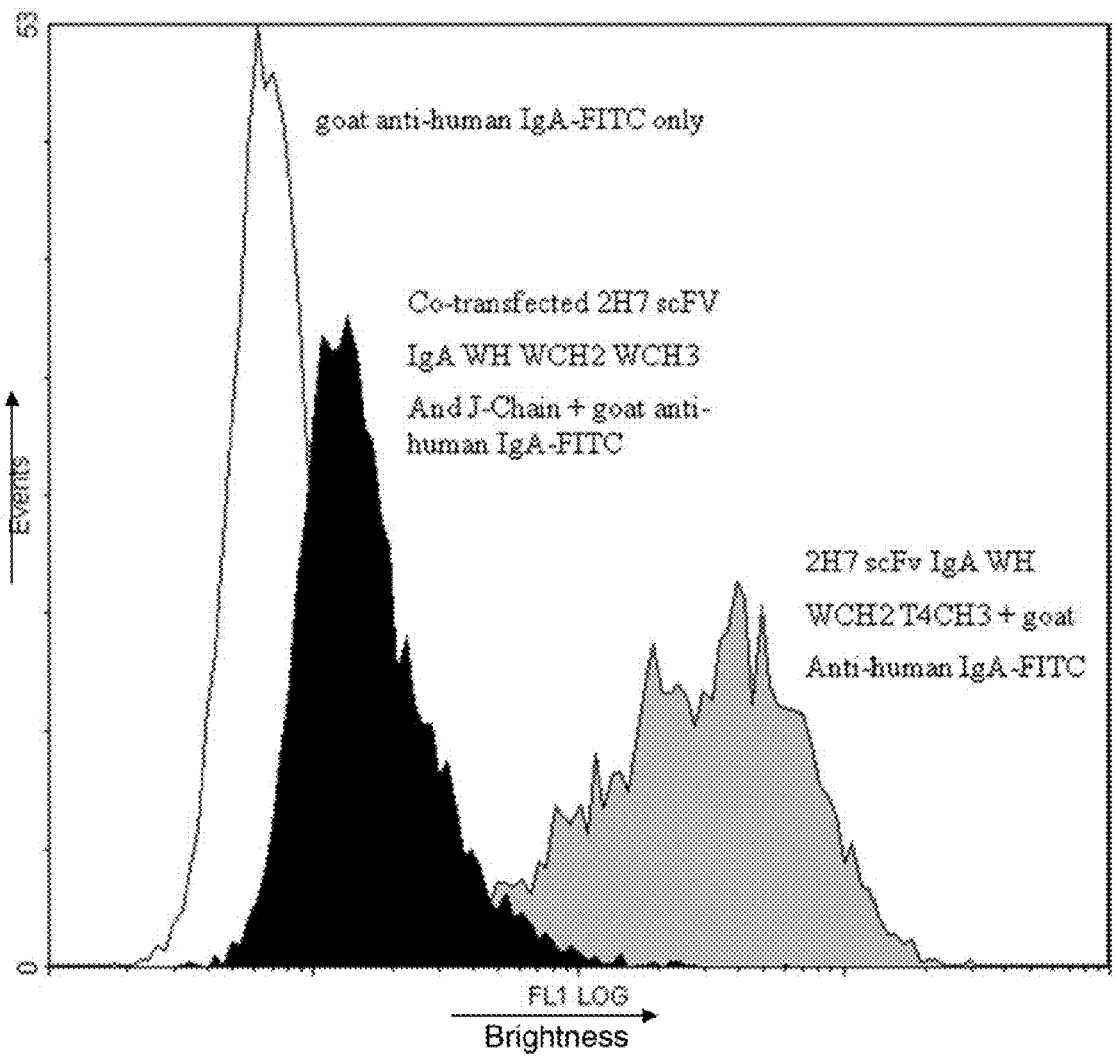

FIG. 36 illustrates binding of 2H7 scFv IgAH IgACH2CH3 polypeptide (SEQ ID NO:62) and 2H7 scFv IgAH IgAT4 (SEQ ID NO:71) to (CD20+) CHO cells by flow immunocytofluorimetry. The source of the polypeptides was culture supernatants from transiently transfected COS cells. COS cells transfected with a plasmid comprising a sequence encoding 2H7 scFv IgAH IgACH2CH3 were co-transfected with a plasmid containing nucleotide sequence encoding human J chain.

Figure 37:
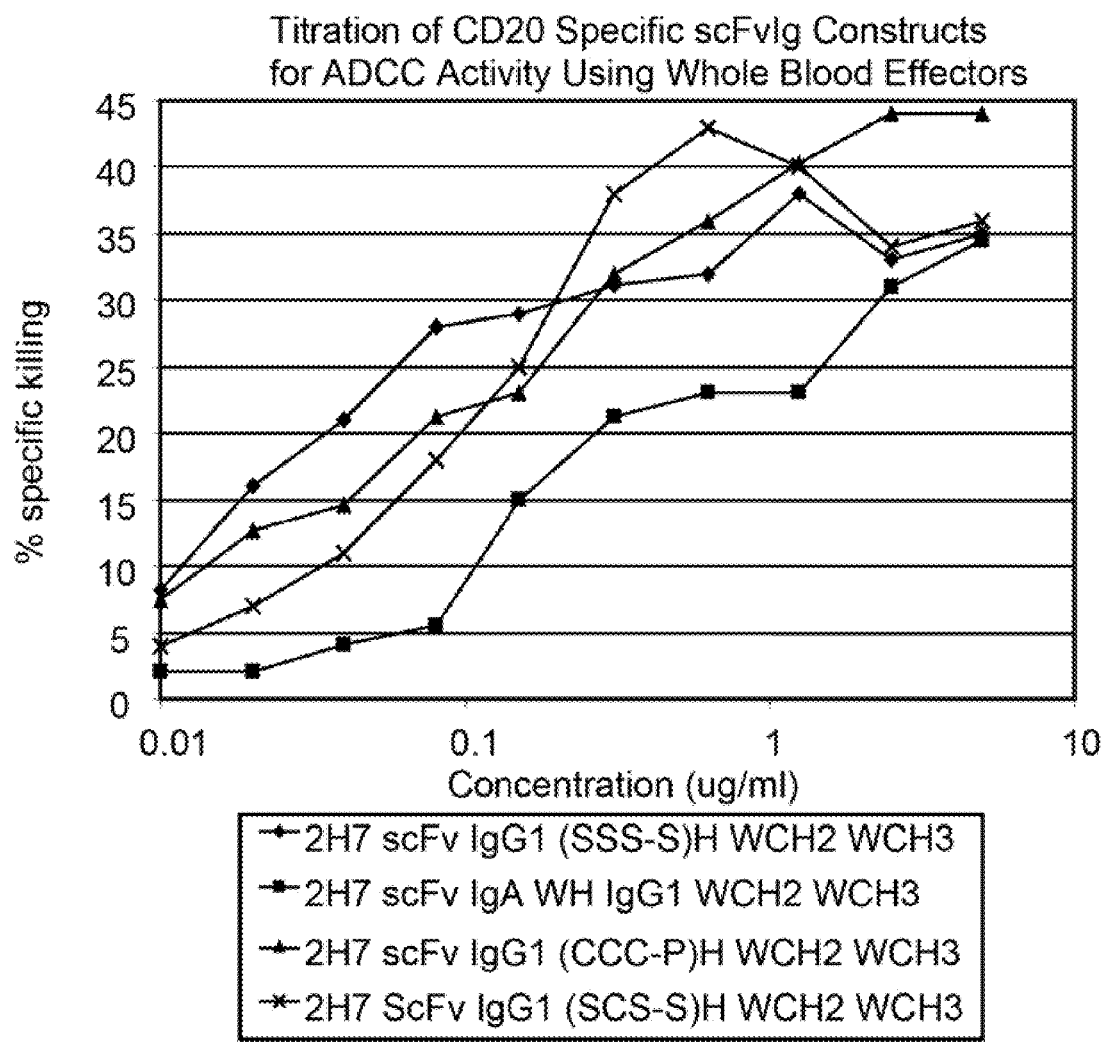

FIG. 37 illustrates antibody dependent cell-mediated cytotoxicity activity of anti-CD20 (2H7) scFv Ig fusion proteins against BJAB target cells using whole blood as the source of effector cells. Purified 2H7 scFv Ig fusion proteins were titrated and combined with $^{51}$Cr-labeled BJAB cells ($5 \times 10^4$) and whole blood (1:4 final dilution). Each data point represents the average percent specific killing measured in four sample wells.

Figure 38:
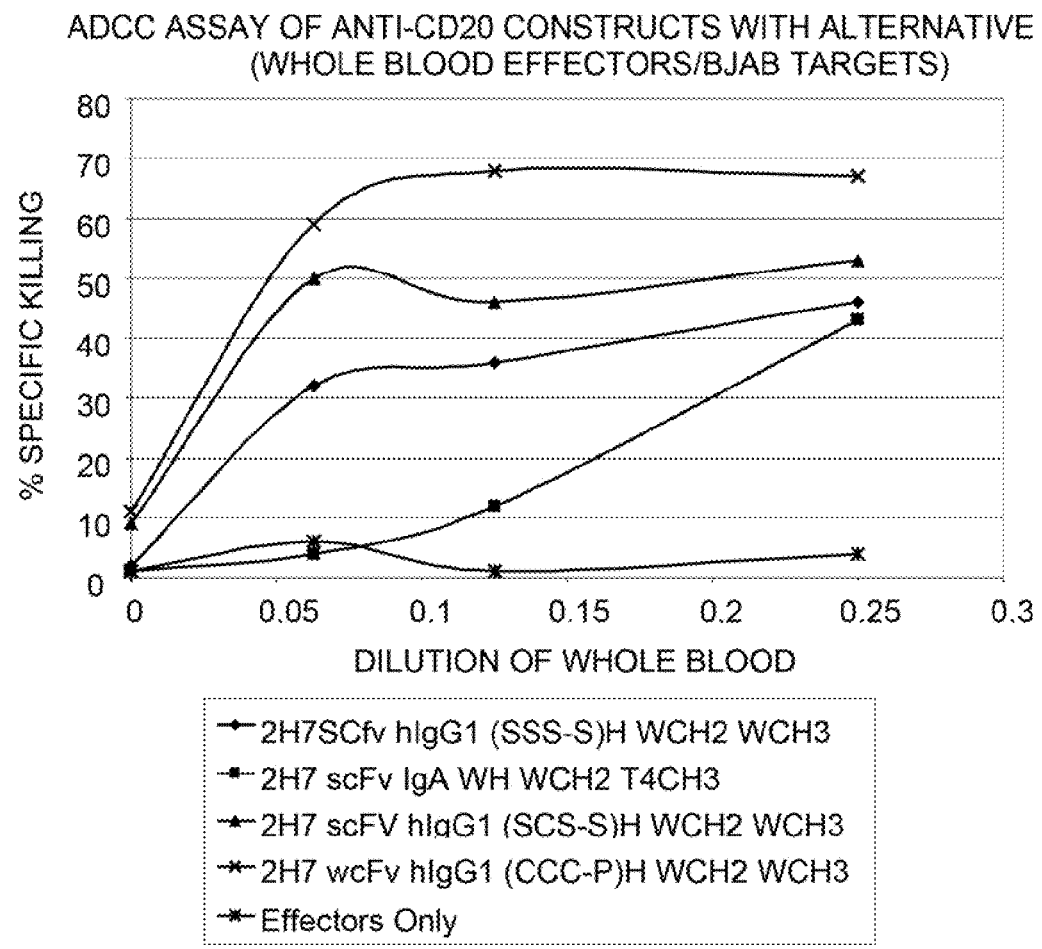

FIG. 38 demonstrates antibody dependent cell-mediated cytotoxicity activity of 2H7 scFv Ig fusion proteins (5 μg/ml) against $^{51}$Cr-labeled BJAB cells at 0.25, 0.125, and 0.625 dilutions of whole blood. Each data point represents the average percent specific killing measured in four sample wells.

FIG. 39 shows a comparison of antibody dependent cell-mediated cytotoxicity activity of 2H7 scFv IgG MTH (SSS) WTCH2CH3 (5 μg/ml) and 2H7 scFv IgAH IgACH2CH3 (5 μg/ml) when human PBMC are the source of effector cells (FIG. 39A) and when human whole blood is the source of effector cells (FIG. 39B).

Figure 40:
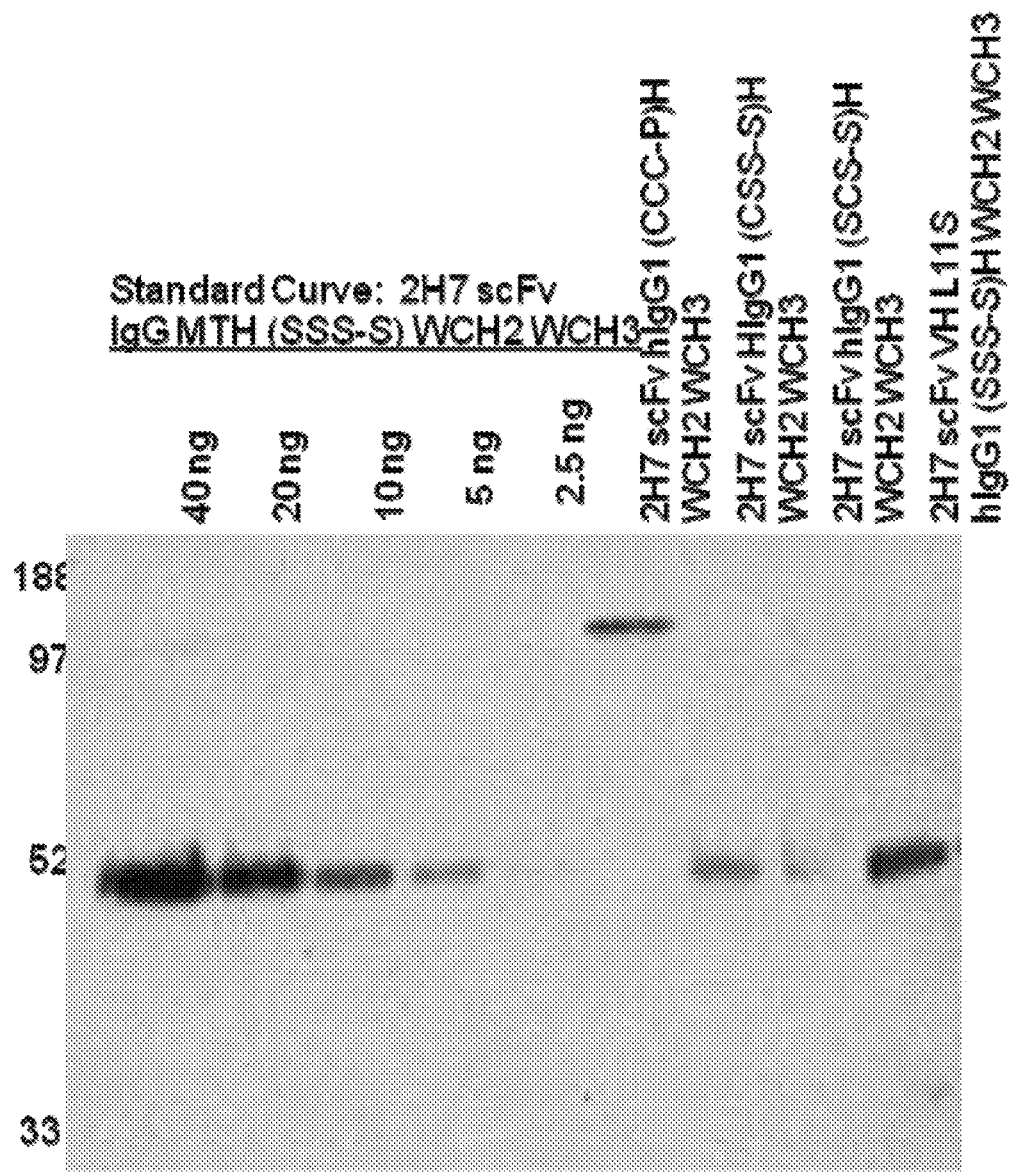

FIG. 40 presents an immunoblot of 2H7 scFv IgG fusion proteins. COS cells were transiently transfected with various 2H7 scFv Ig fusion protein constructs. Culture supernatants containing the expressed polypeptides were separated in a non-reducing SDS polyacrylamide gel, and then were transferred to a polyvinyl fluoride membrane. Proteins were detected using an anti-human IgG (Fc specific) horseradish peroxidase conjugate. Lanes 1-5: purified 2H7 scFv IgG MTH (SSS) WTCH2CH3 at 40 ng, 20 ng, 10 ng/5 ng, and 2.5 ng per lane, respectively. Culture supernatants were separated in lanes 6-9. Lane 6: 2H7 scFv IgG WTH (CCC) WTCH2CH3; lane 7: 2H7 scFv IgG MTH (CSS) WTCH2CH3; lane 8: 2H7 scFv IgG MTH (SCS) WTCH2CH3; and lane 9: 2H7 scFv VHSER11 IgG MTH (SSS) WTCH2CH3. The molecular weight (kDal) of marker proteins is indicated on the left side of the immunoblot.

Figure 41:
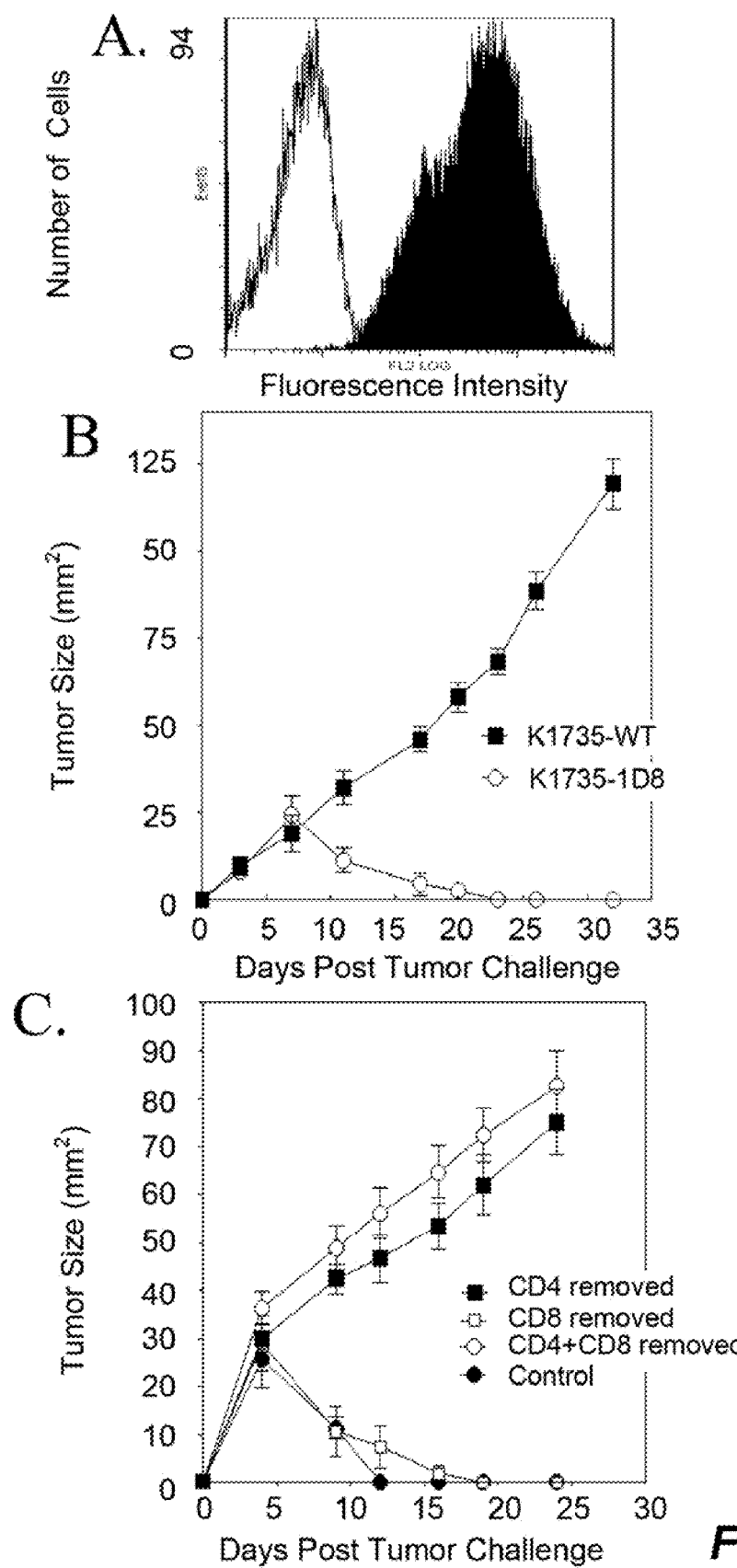

FIG. 41 illustrates cell surface expression of 1D8 (anti-murine 4-1BB) scFv IgG WTH WTCH2CH3-CD80 fusion protein on K1735 melanoma cells by flow immunofluorimetry (FIG. 41A). The scFv fusion protein was detected with phycoerythrin-conjugated F(ab')$_2$ goat anti-human IgG. FIG. 41B depicts growth of tumors in naïve C3H mice transplanted by subcutaneous injection with wild type K1735 melanoma cells (K1735-WT) or with K1735 cells transfected with 1D8 scFv IgG WTH WTCH2CH3-CD80 (K1735-1D8). Tumor growth was monitored by measuring the size of the tumor. FIG. 41C demonstrates the kinetics of tumor growth in naïve C3H mice injected intraperitoneally with monoclonal antibodies to remove CD8$^+$, CD4$^+$, or both CD4$^+$ and CD8$^+$ T cells prior to transplantation of the animals with K1735-1D8 cells.

Figure 42:
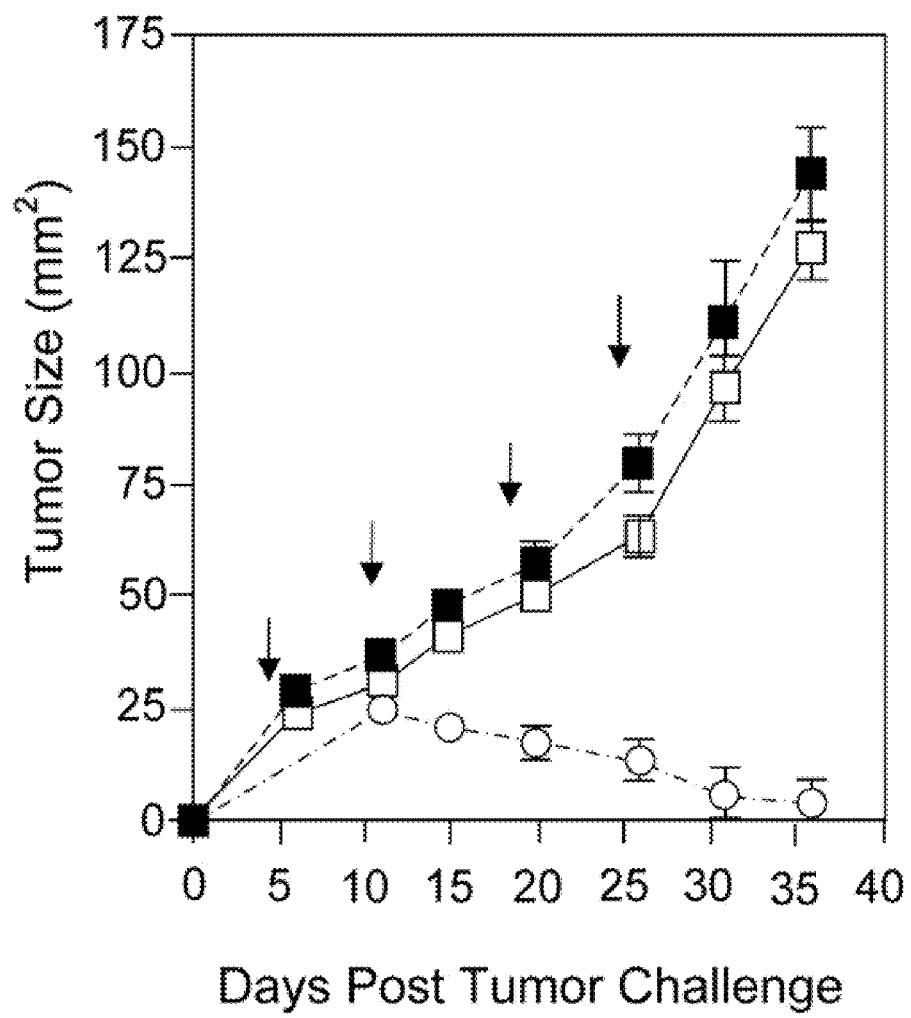

FIG. 42 demonstrates therapy of established K1735-WT tumors using K1735-1D8 as an immunogen. Six days after mice were transplanted with K1735-WT tumors, one group (five animals) was injected subcutaneously with K1735-1D8 cells (open circles) or irradiated K1735-WT cells (solid squares) on the contralateral side. A control group of mice received PBS (open squares). Treatments were repeated on the days indicated by the arrows.

Figure 43:
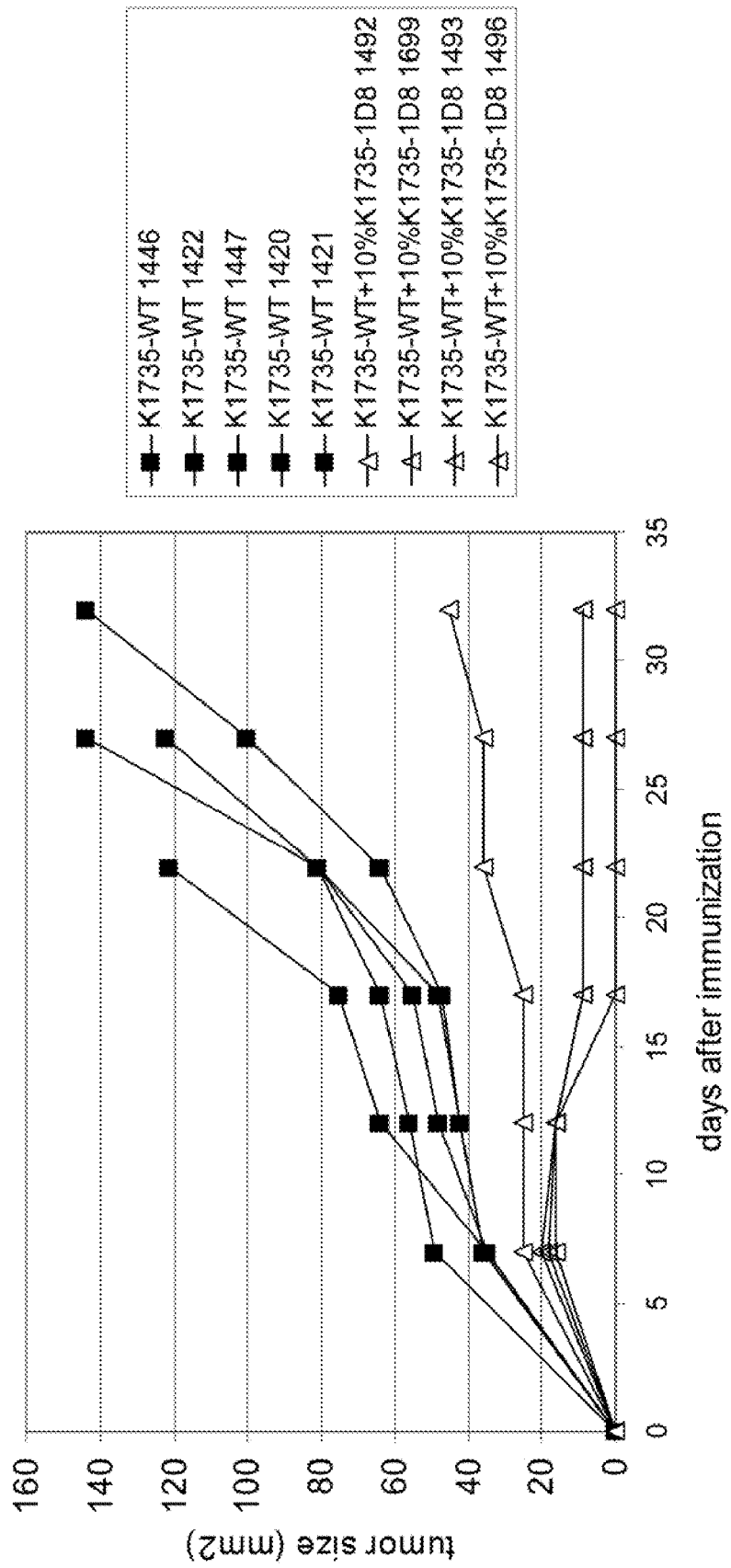

FIG. 43 shows the growth of tumors in animals that were injected subcutaneously with $2 \times 10^6$ K1735-WT cells (solid squares) and the growth of tumors in animals that were injected subcutaneously with $2 \times 10^6$ K1735-WT cells plus $2 \times 10^5$ K1735-1D8 cells (open triangles).

Figure 44:
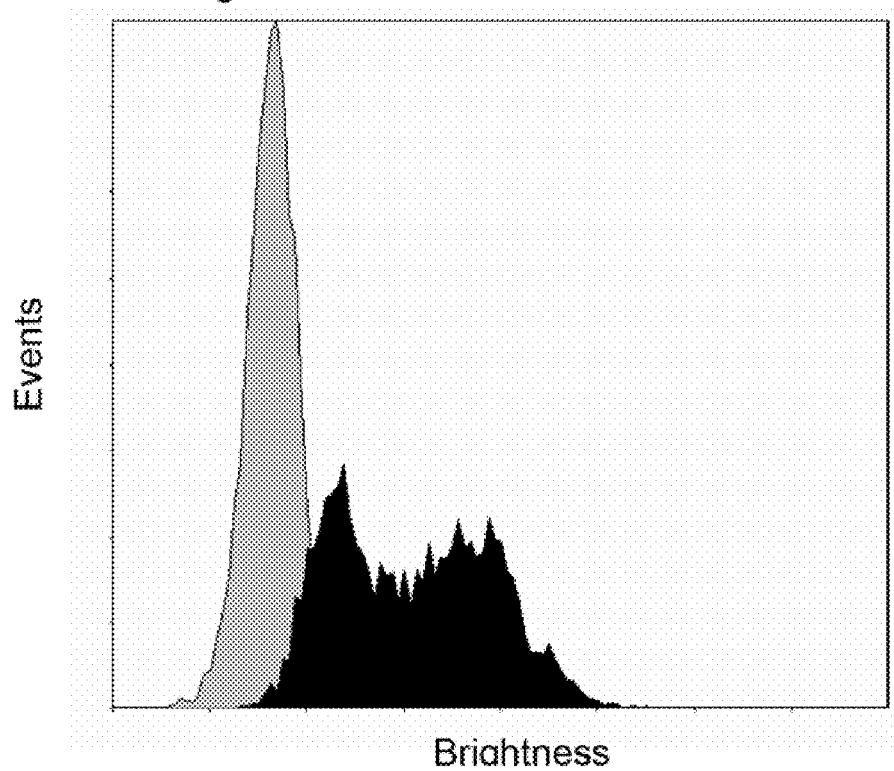

FIG. 44 presents a flow cytometry analysis of antigen104 murine sarcoma tumor cells transfected with 1D8 scFv IgG WTH WTCH2CH3-CD80 isolated after repeated rounds of panning against anti-human IgG. Transfected cells expressing 1D8 scFv IgG WTH WTCH2CH3-CD80 were detected with fluoroisothiocyanate (FITC)-conjugated goat anti-human IgG (depicted in black). Untransfected cells are shown in gray.

Figure 45:
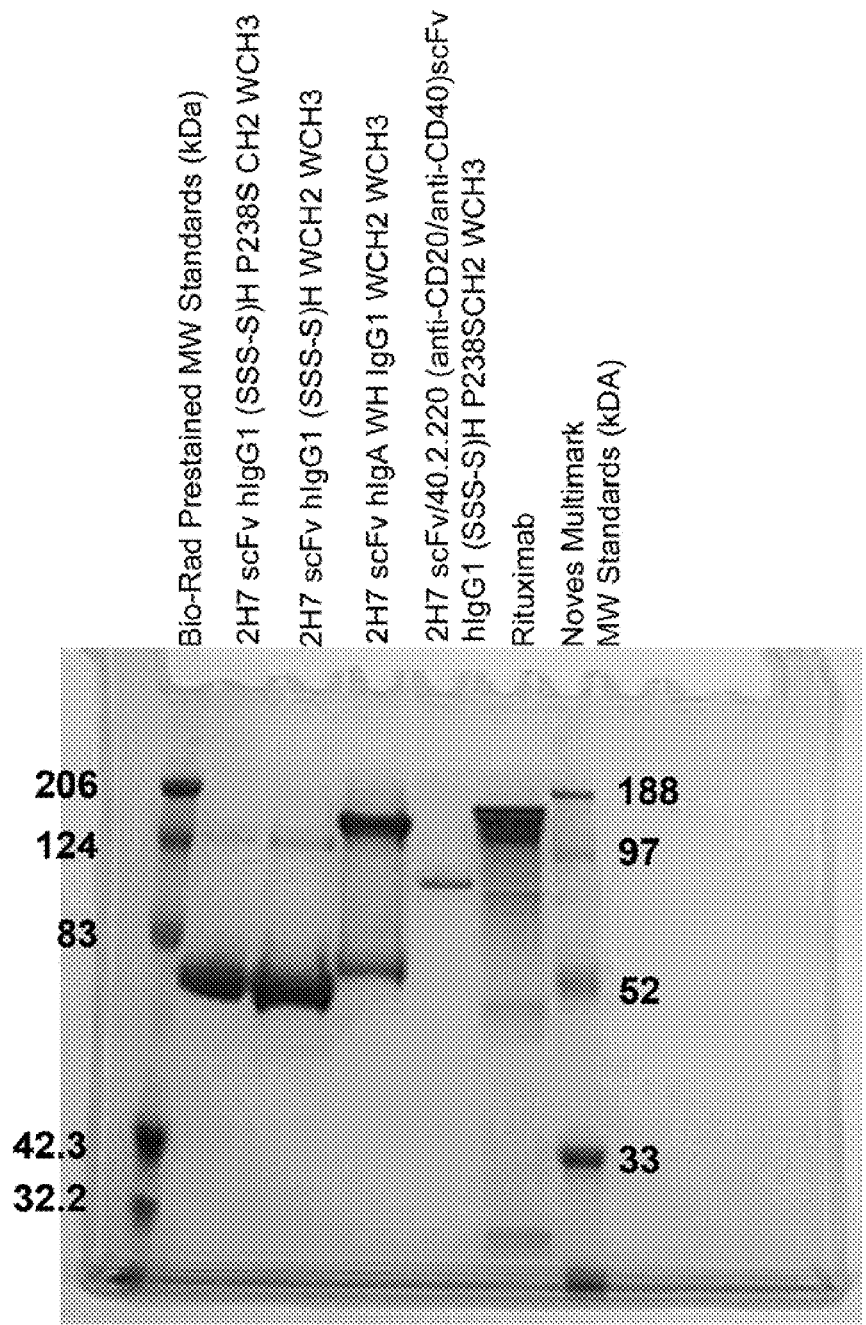

FIG. 45 illustrates migration of various 2H7 scFv Ig fusion proteins in a 10% SDS-PAGE gel. 2H7 was the anti-CD20 scFv and 40.2.220 was the anti-CD40 scFv. Lane 1: Bio-Rad prestained molecular weight standards; lane 2: anti-CD20 scFv IgG MTH (SSS) MTCH2WTCH3; lane 3: anti-CD20 scFv IgG MTH (SSS) WTCH2CH3; lane 4: 2H7 scFv IgAH IgG WTCH2CH3; lane 5: anti-CD20-anti-CD40 scFv IgG MTH (SSS) MTCH2WTCH3; lane 6: Rituximab; lane 7: Novex Multimark® molecular weight standards.

Figure 46:
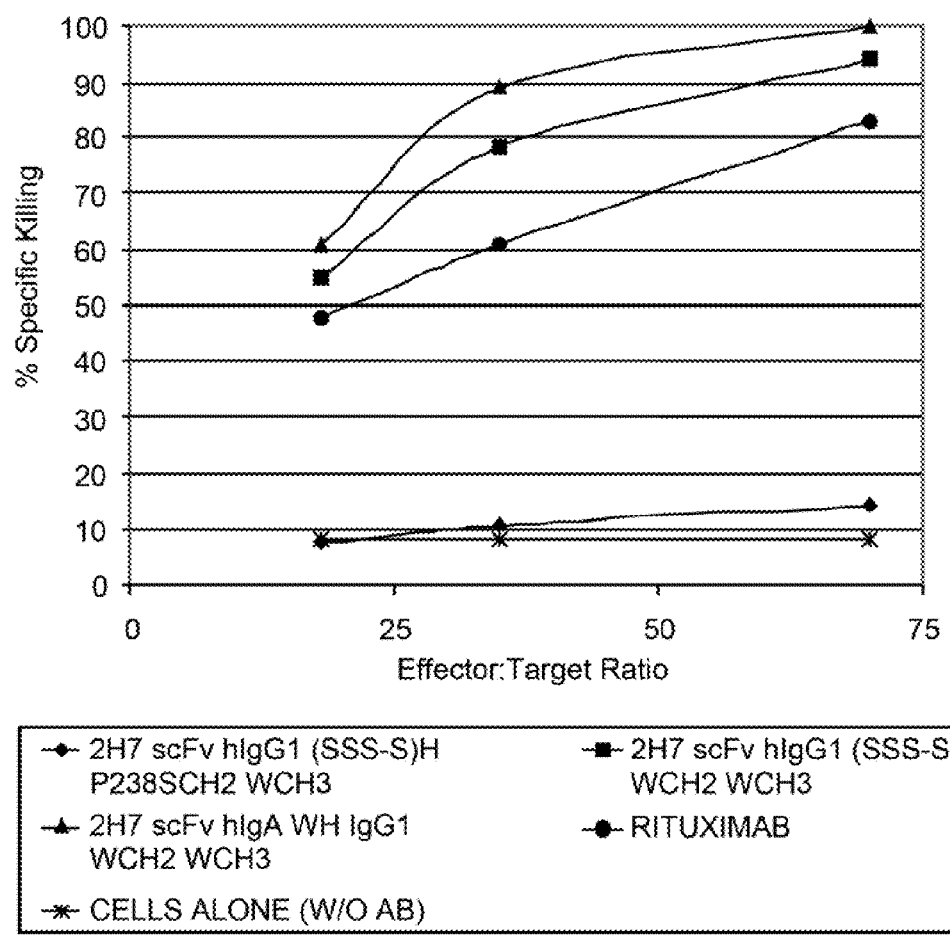

FIG. 46 illustrates effector function as measured in an antibody dependent cell-mediated cytotoxicity assay of 2H7 Ig fusion proteins that contain a mutant CH2 domain or wild type CH2 domain. The percent specific killing of BJAB target cells in the presence of human PBMC effector cells by 2H7 scFv IgG MTH (SSS) MTCH2WTCH3 (diamonds) was compared to 2H7 scFv IgG MTH (SSS) WTCH2CH3 (squares) and 2H7 scFv IgAH IgG WTCH2CH3 (triangles) and Rituximab (circles).

FIG. 47 shows cell surface expression of an anti-human CD3 scFv IgG WTH WTCH2CH3-CD80 (SEQ ID NO:413) fusion protein on Reh cells (FIG. 47A) and T51 lymphoblastoid cells (FIG. 47B) by measuring the linear fluorecent equivalent (LFE) using flow immunocytofluorimetry.

FIG. 48 presents the percent specific killing of untransfected Reh and T51 cells and the percent specific killing of Reh cells (Reh anti-hCD3) (FIG. 48A) and T51 cells (T51 anti-hCD3) (FIG. 48B) that were transfected with a construct encoding scFv antibodies specific for human CD3, fused to human IgG1 wild-type hinge-CH2-CH3, which was fused to human CD80 transmembrane and cytoplasmic tail domains (anti-human CD3 scFv IgG WTH WTCH2CH3-CD80 (SEQ ID NO:29). Human PBMC (effector cells) were combined with BJAB target cells at the ratios indicated.

Figure 49:
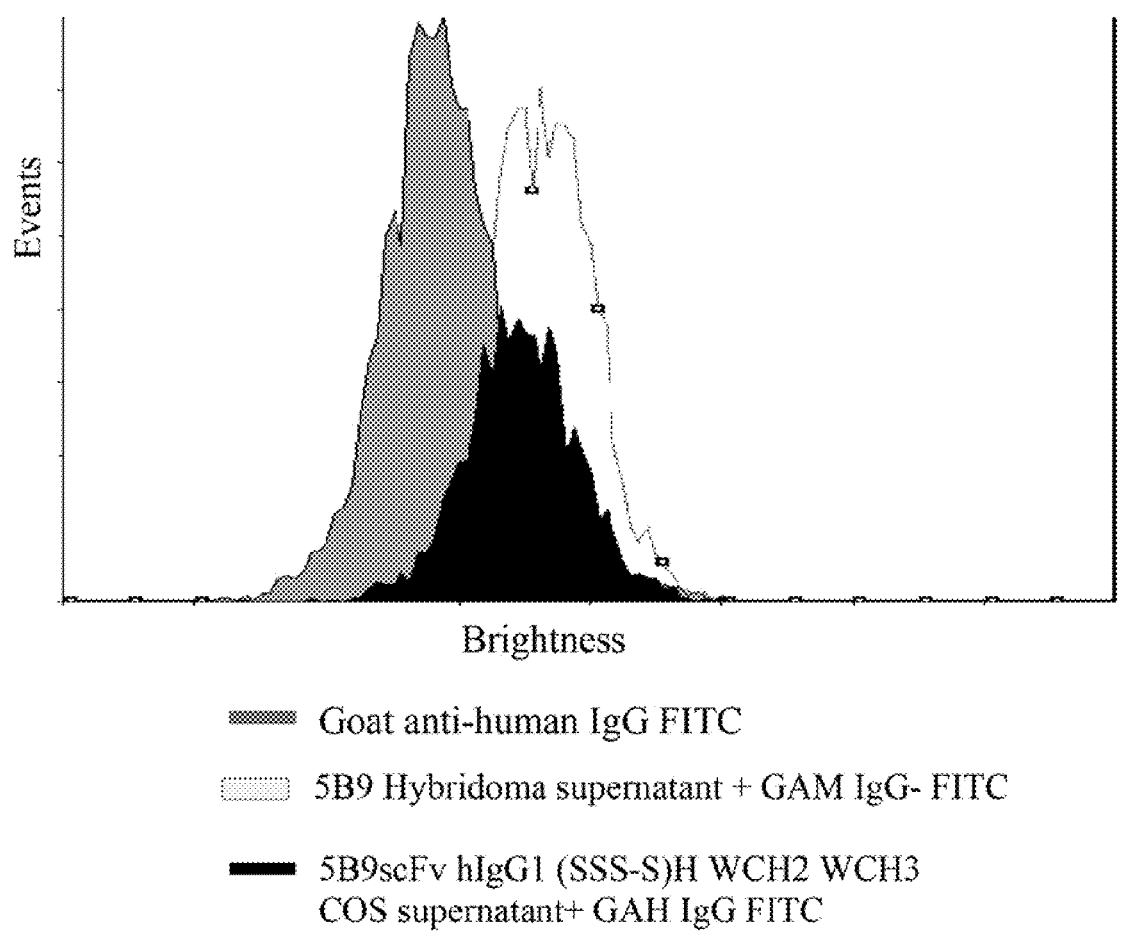

FIG. 49 illustrates binding of 5B9, an anti-murine CD137 (4-1BB) monoclonal antibody, and a 5B9 scFv IgG fusion protein (5B9 scFv IgG MTH (SSS) WTCH2CH3 (SEQ ID NO:133) to stimulated human PBMC. Binding of the 5B9 scFv IgG fusion protein was detected by flow immunocytofluorimetry using FITC conjugated goat anti-human IgG. Binding of the 5B9 monoclonal antibody was detected with FITC conjugated goat anti-mouse IgG.

FIG. 50 illustrates the effect of the $LV_H11S$ mutation on the expression of 2H7 $LV_H11S$ scFv WCH2 WCH3 ("CytoxB scFv Ig"; SEQ ID NO:369) in CHO cell lines.

Figure 51:
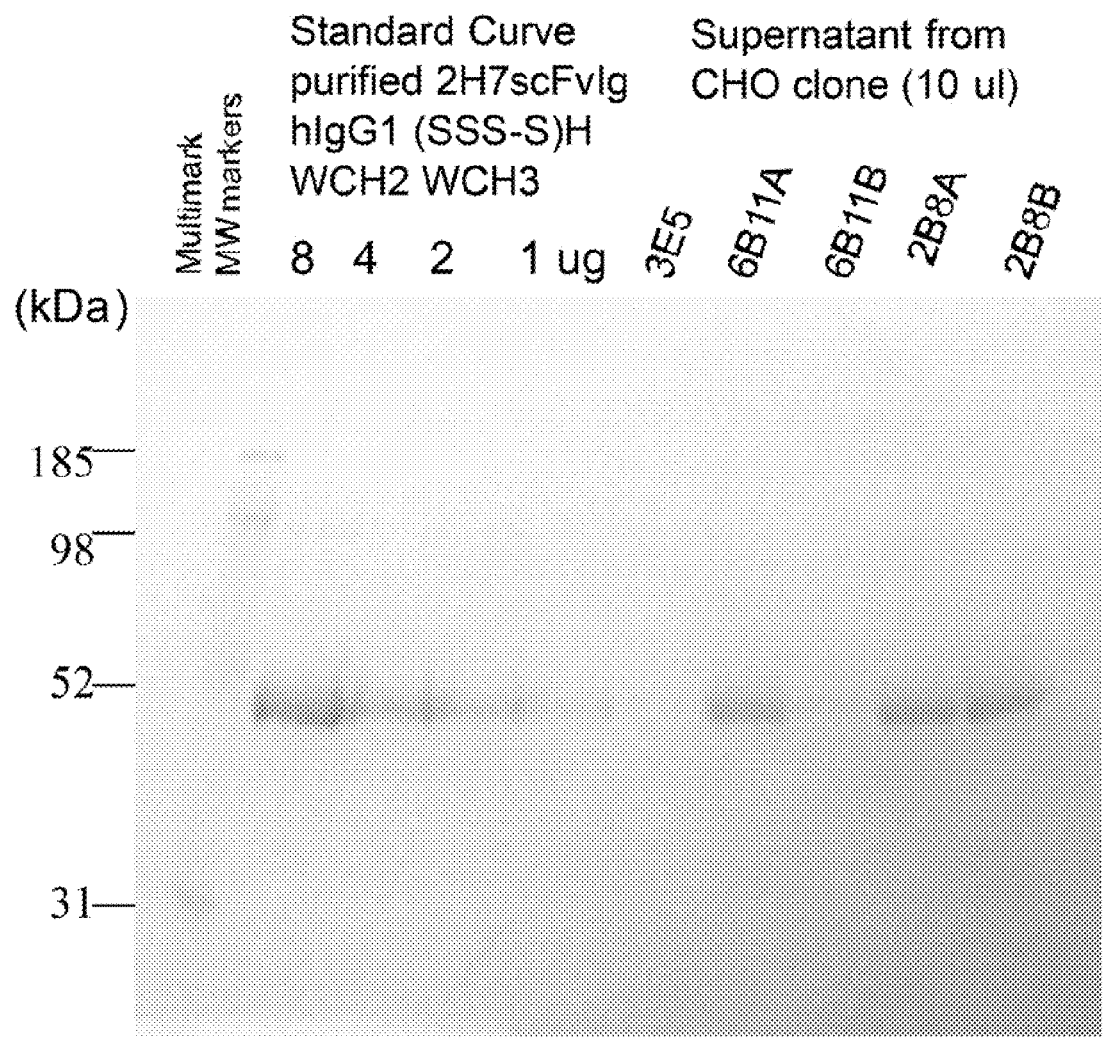

FIG. 51 shows a semi-quantitative SDS-PAGE analysis examining the expression of 2H7 $LV_H11S$ scFv WCH2 WCH3 (SEQ ID NO:369) when transiently transfected in CHO cells. Lanes 2-5 are various amounts of 2H7 $LV_H11S$ scFv WCH2 WCH3. Lanes 6-10 are 10 µl samples from five different clones expressing 2H7 $LV_H11S$ scFv WCH2 WCH3.

Figure 52:
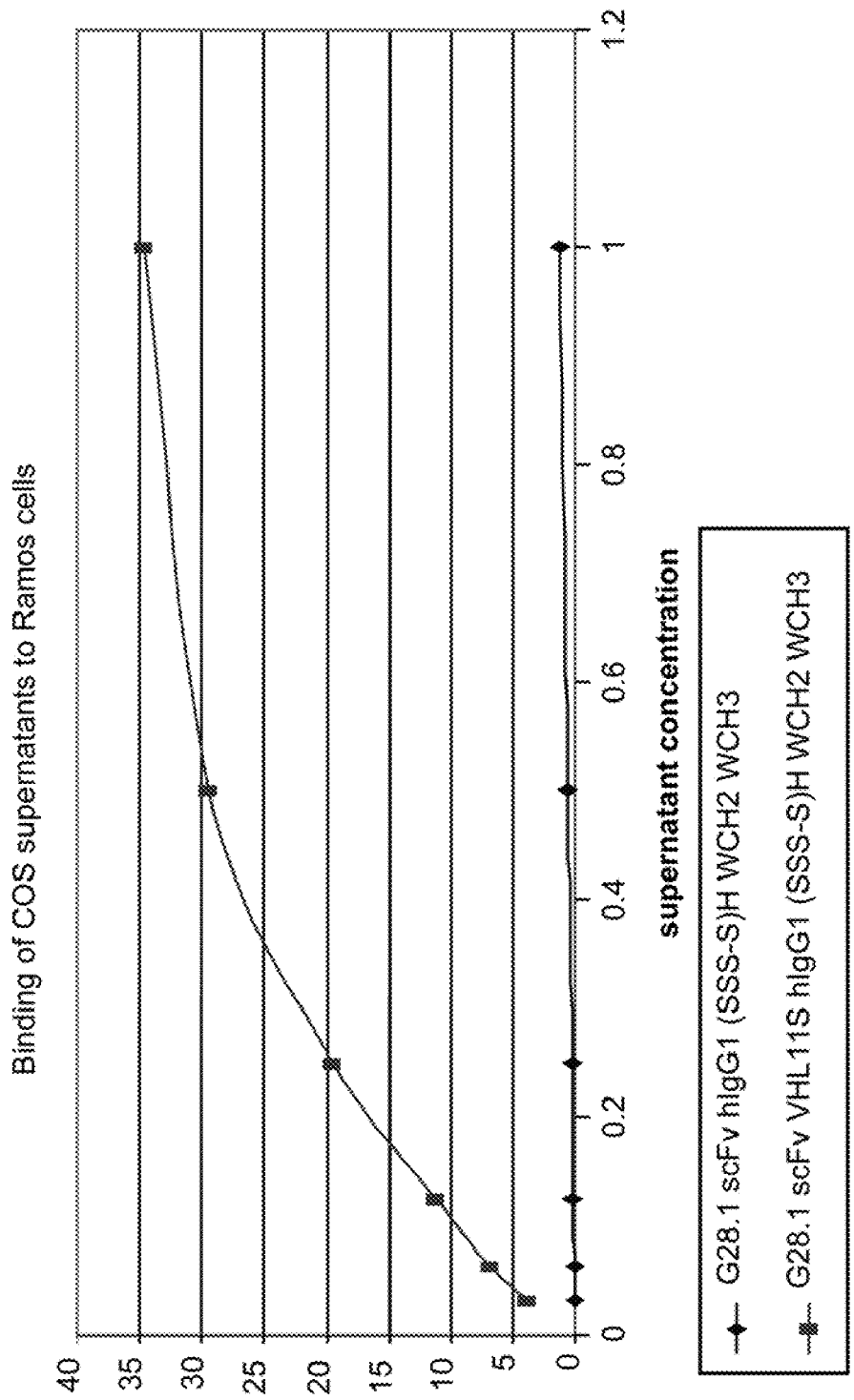

FIG. 52 shows differences in binding capacity between a G28-1 $LV_H11S$ scFv Ig construct (SEQ ID NO:324) and a G28-1 wild type scFv Ig binding domain fusion protein construct (SEQ ID NO:320), both obtained from transiently transfected COS cells. Binding to Ramos cells was determined using flow cytometry. The data illustrates a significant increase in binding of the $V_H11S$ protein to CD37+Ramos cells.

Figure 53A:
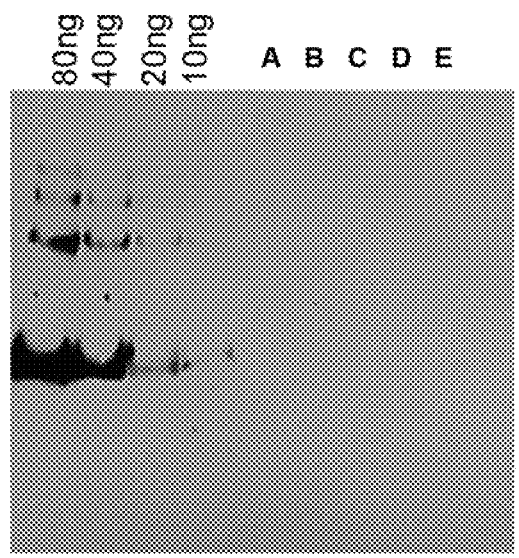
Figure 53B:
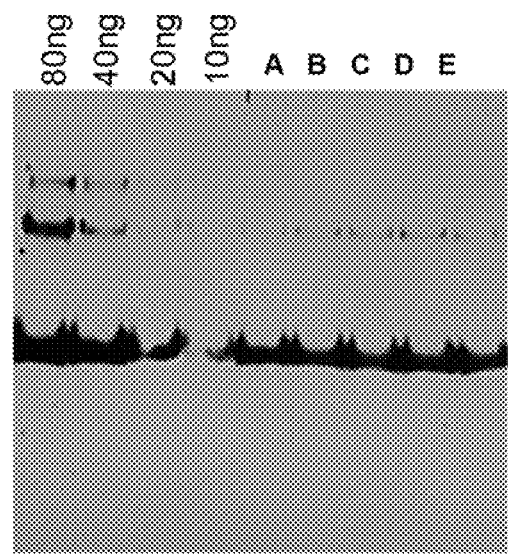

FIG. 53 illustrates increased levels of expression of a G28-1 $LV_H11S$ scFv Ig construct (SEQ ID NO:324) compared to a G28-1 wild type scFv Ig construct in COS. Protein levels were compared using immunoblot analysis. Both immunoblot gels have quantitated amounts of purified a G28-1 scFv Ig (SSS) H WCH2 WCH3 contruct of the invention in lanes 1-4. Lanes 5-9 of the first immunoblot represent five different clones each transfected with G28-1 scFv (SSS) H WCH2 WCH3, while lanes 5-9 of the second immunoblot represent five different clones transfected with G28-1 $LV_H11S$ scFv (SSS) H WCH2 WCH3. The immunoblots illustrate that the $LV_H11S$ form causes the G28-1 scFv Ig construct to express at very high levels.

Figure 54:
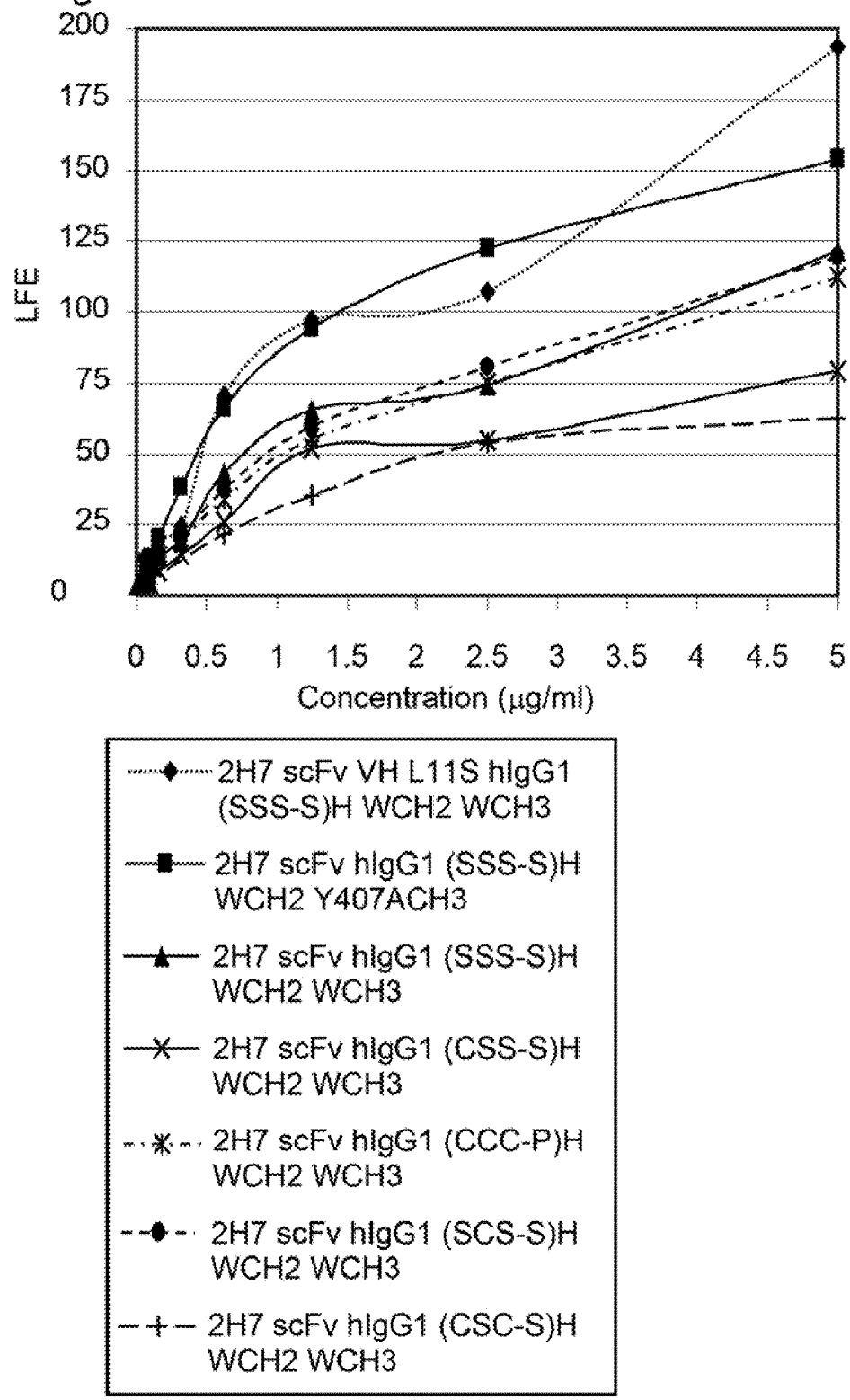

FIG. 54 illustrates the binding of 2H7 scFv Ig derivatives with altered hinges) to CHO cells expressing CD20 (CD20+ CHO) by flow cytometry, and indicates that these altered connecting region hinge constructs (including (SSS-S), (CSS-S), (SCS-S) and (CSC-S) hinge regions) retain binding function to CD20.

Figure 55:
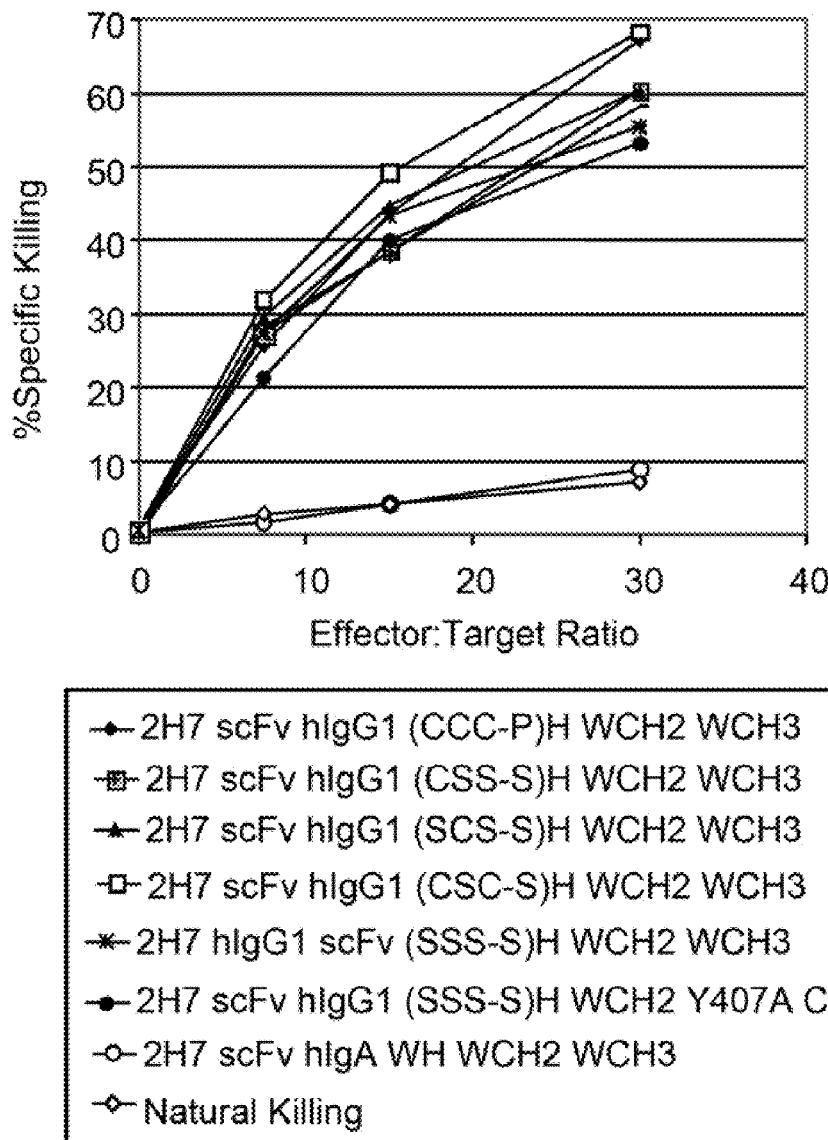

FIG. 55 shows the ability to mediate antibody dependent cell-mediated cytotoxicity of various constructs against Bjab targets: (A) 2H7 scFv Ig constructs of the invention that contain connecting regions comprising (CSS-S), (SCS-S), (CSC-S), and (SSS-S) hinges and (B) 2H7 scFv constructs of the invention with various connecting regions and tail regions. Percent specific killing is compared to total killing induced by a detergent. The controls are natural killing in target cells with effectors added and a 2H7 construct with an IgA hinge connecting region and IgA-derived tail region that does not bind PBMC effectors.

Figure 56:
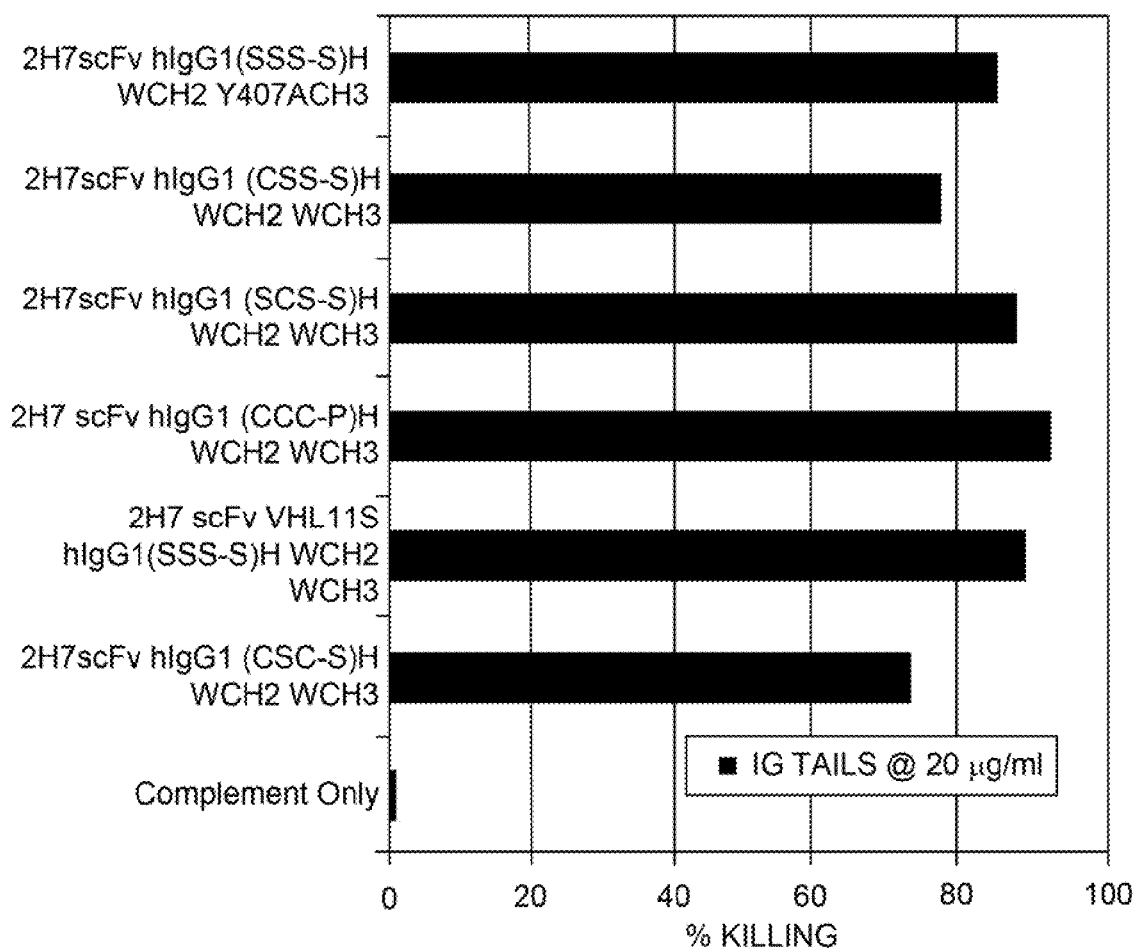

FIG. 56 illustrates the ability of various 2H7 scFv Ig constructs of the invention that include connecting regions having various hinge regions (e.g., (CSC-S), (SSS-S), (SCS-S), and (CSS-S)) to mediate complement activity in Ramos cells. Percent specific killing is measured against the control of complement only, and 100% killing was determined by exposure of cells to detergent.

Figure 57:
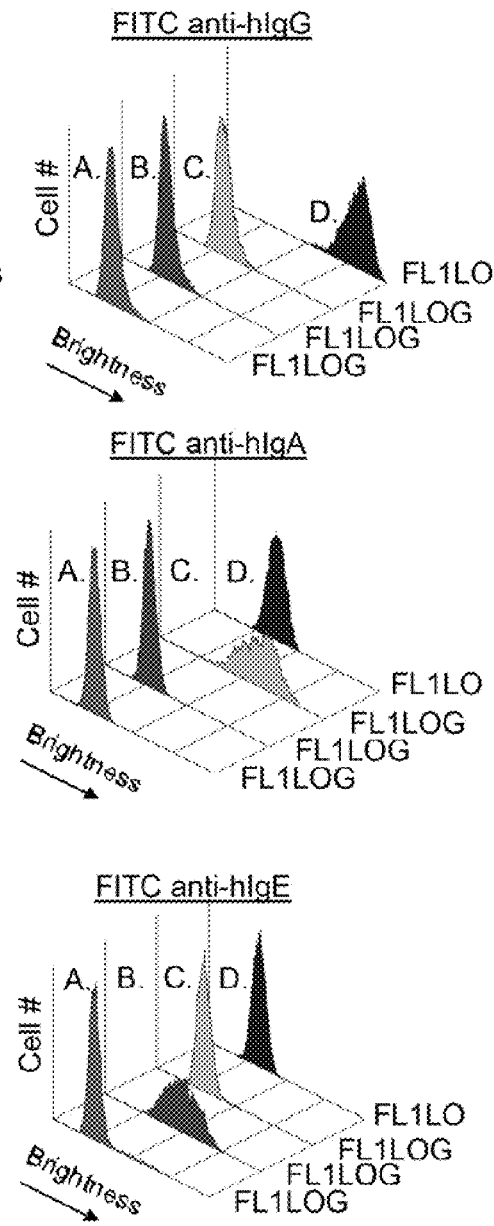

FIG. 57 illustrates the shows the binding of 2H7 scFv Ig constructs of the invention containing different tail regions to CD20+CHO using immunocytofluoroimetry. The different proteins were detected using FITC conjugated to anti-IgG, anti-IgA, and anti-IgE.

FIG. 58A shows the binding of 2H7 $V_H$ L11S scFv IgECH2CH3CH4, purified using Hydrophobic charge induction chromatography (HCIC) and eluted at different pHs 4.0 and 3.5, in CD20+CHO cells by flow cytometry, indicating that the proteins bound CD20 whether eluted at pH 4.0 or 3.5. FIG. 58B is a data graph indicating the ability of these 2H7 VH L11S scFv IgE constructs of the invention to mediate, for example, ADCC in Bjab target cells.

Figure 59:
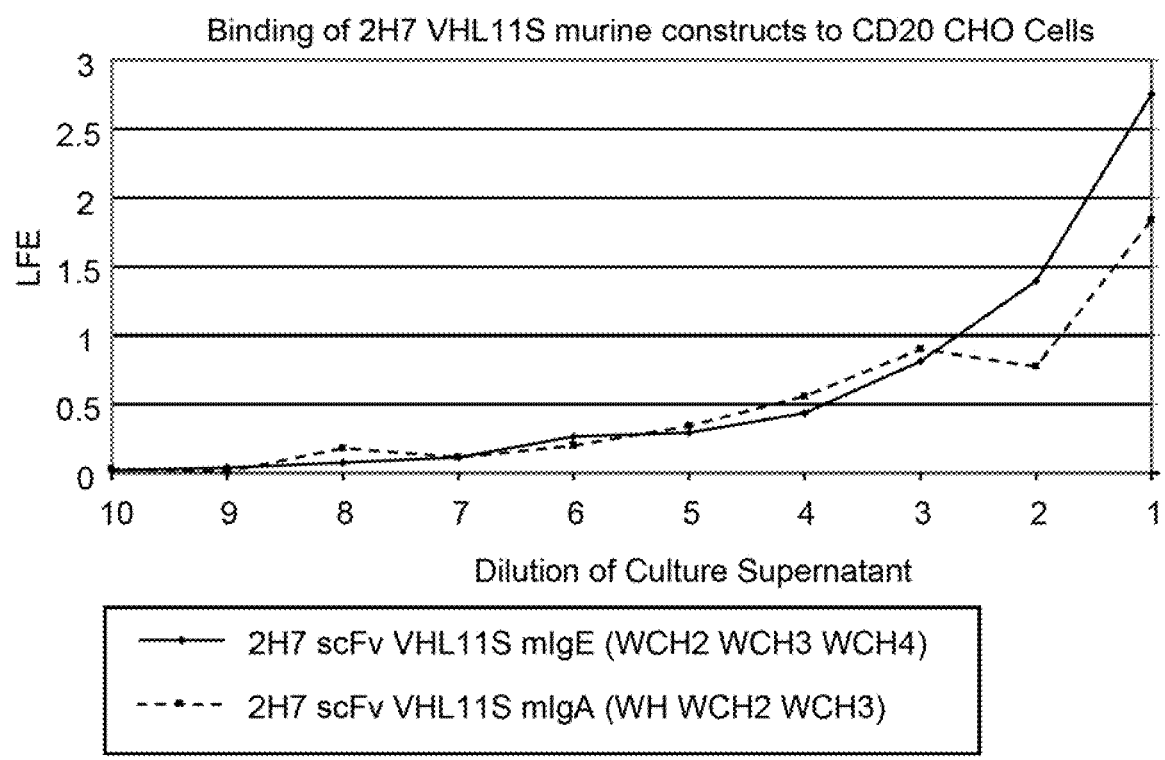

FIG. 59 shows the binding capacity of G28-1 VH L11S mIgECH2CH3CH4 (A) to Bjab and Ramos target cells and (B) to CD20+CHO cells by flow cytometry.

Figure 60:
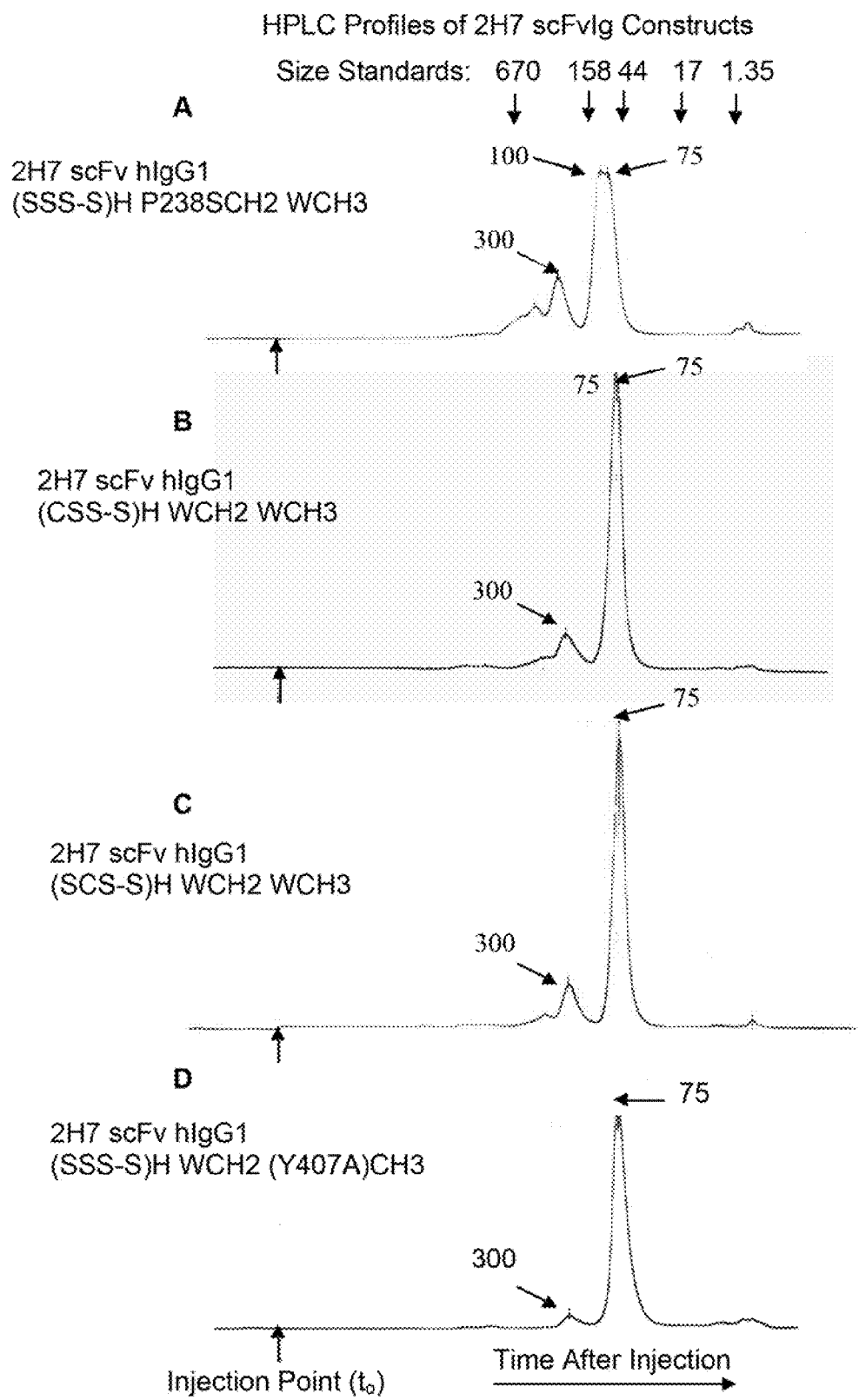

FIG. 60 shows the High Performance Liquid Chromatography (HPLC) profiles of various protein constructs of the invention (A) 2H7 scFv (SSS-S) H (P238S)CH2 WCH3 (B) 2H7 scFv (CSS-S) H WCH2 WCH3, (C) 2H7 scFv (SCS-S) H WCH2 WCH3, and (D) 2H7 scFv (SSS-S) H WCH2 (Y407A)CH3, indicating that construct A has apparent molecular weight forms of 100 kD and 75 kD and that, by introducing certain changes a predominant 75 kD molecular weight form is obtained, as seen in constructs B, C, and D. See Example 40.

FIG. 61 shows the HPLC profiles of various protein constructs of the invention (A) 2H7 scFv (SSS-S) H WCH2 WCH3, (B) 2H7 scFv (CSC-S) H WCH2 WCH3, (C) 2H7 scFv (CCC-P) H WCH2 WCH3, and (D) 2H7 scFv IgAH WCH2 WCH3, indicating that construct A has apparent molecular weight forms of 100 kD and 75 kD and that, by introducing certain changes a predominant 75 kD molecular weight form is obtained, as seen in constructs B and C, while construct D (which has an IgA tail regaion) has an apparent molecular weight of 150 kD. See Example 40.

Figure 62:
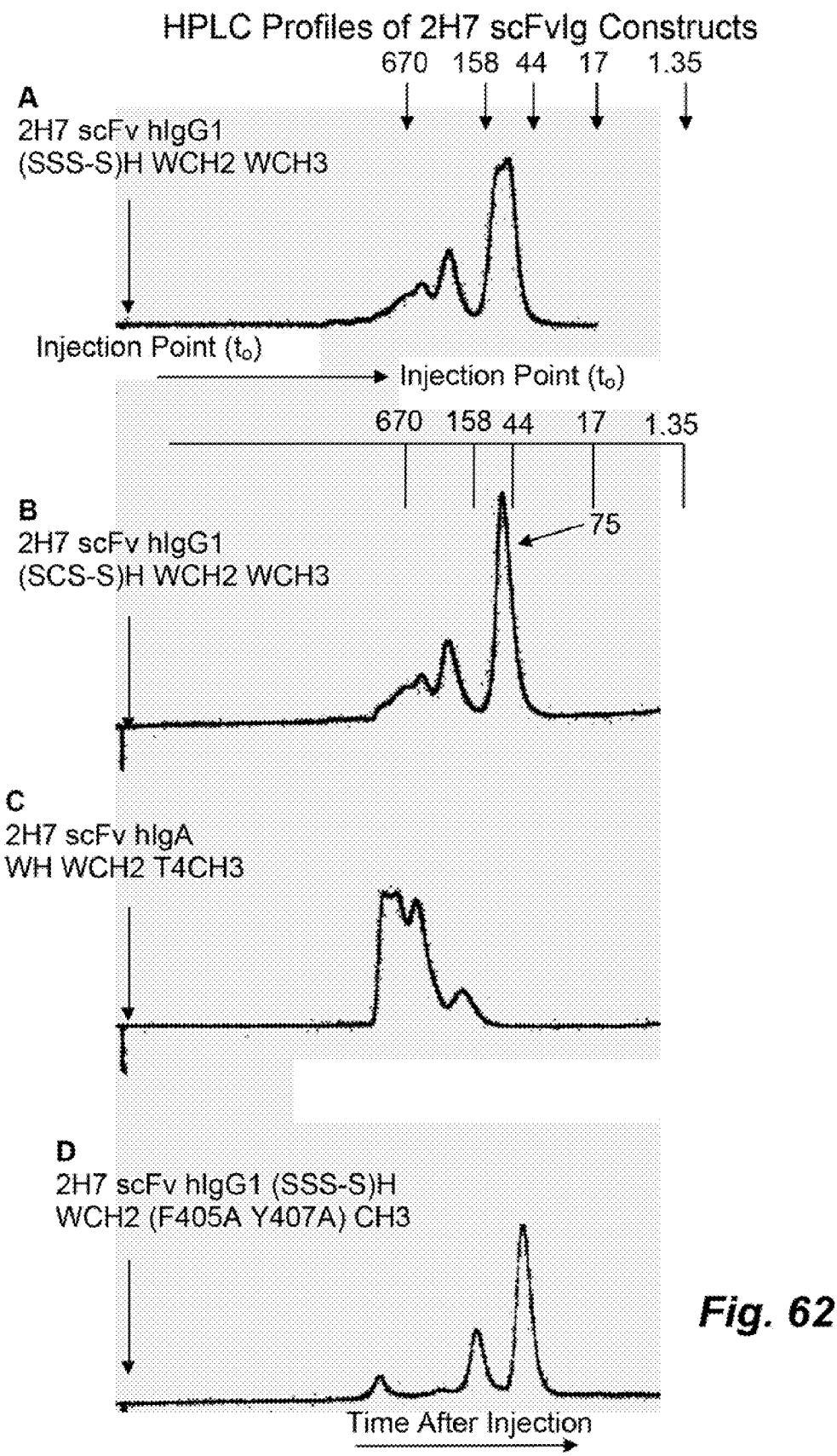

FIG. 62 shows the HPLC profiles of various protein constructs of the invention (A) 2H7 scFv (SSS-S) H WCH2 WCH3, (B) 2H7 scFv (SCS-S) H WCH2 WCH3, (C) 2H7 scFv IgA 3TCH2 WCH3, and (D) 2H7 scFv (SSS-S) H WCH2 (F405A Y407A)CH3, indicating that construct A has two forms with apparent molecular weights at 100 kD and 75 kD, construct B has a predominant form with an apparent molecular weight of 75 kD, while construct C with a T4 mutation leads to three forms with apparent molecular weights near 600 kD and construct D with a double point mutation in the CH3 region leads to a predominant form having an apparent molecular weight less than 44 kD. A T4 mutation here refers to a truncation of four amino acids from a CH3 region. See Example 40.

Figure 63:
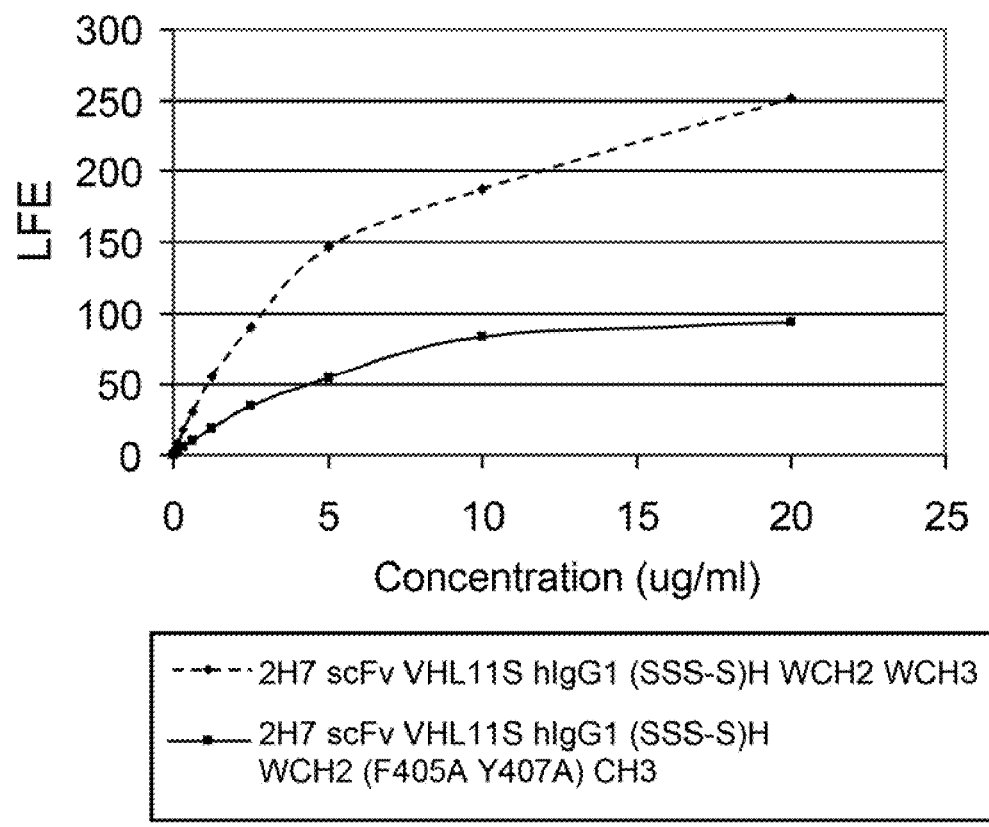

FIG. 63 compares the effect on binding CD20+CHO cells by 2H7 V$_H$L11S scFv Ig constructs, with and without F405A and Y407A alterations in the CH3 region, by flow cytometry, indicating a loss of binding capability with this double amino acid change. See Example 41.

Figure 64:
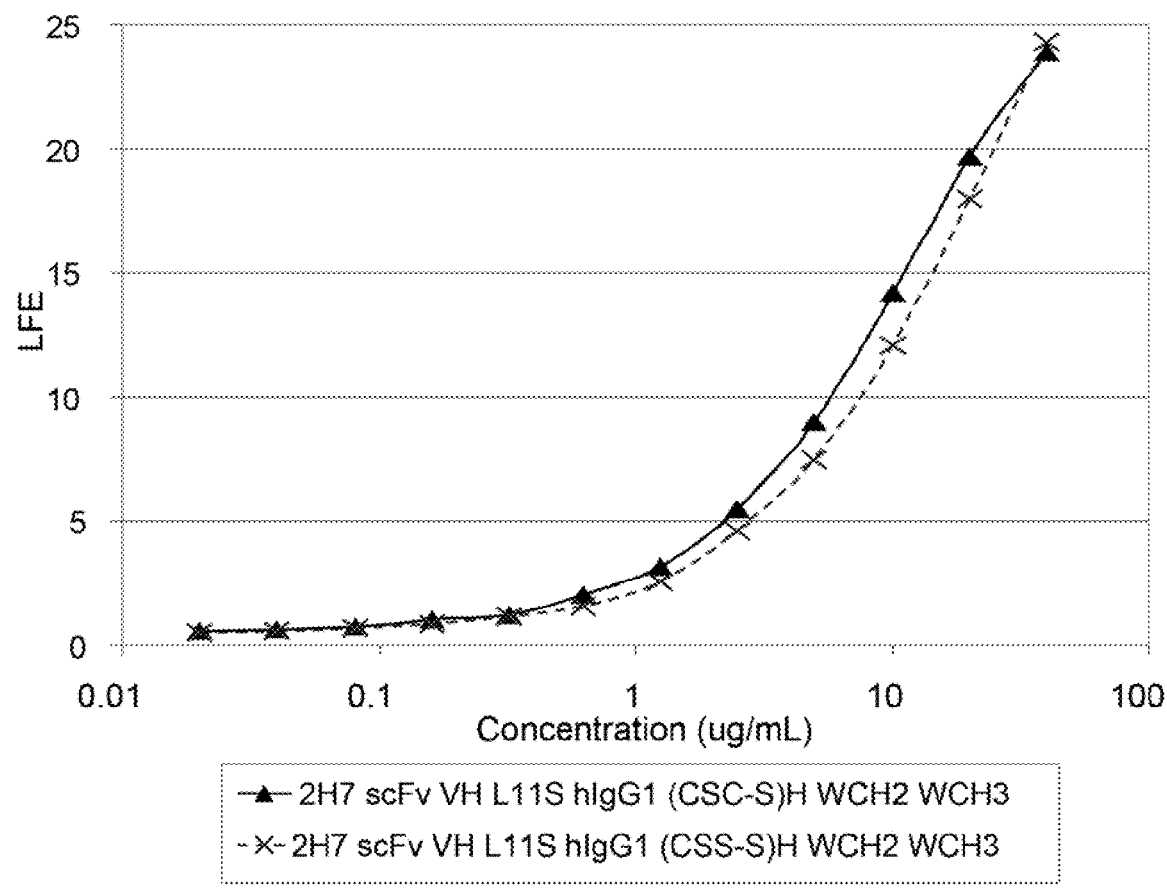

FIG. 64 shows the binding capacity of FITC conjugated 2H7 V$_H$ L11S scFv Ig derivatives to CH20+CHO cells by flow cytometry, indicating that these constructs do not lose binding capacity when conjugated to a florescent marker. See Example 41.

Figure 65:
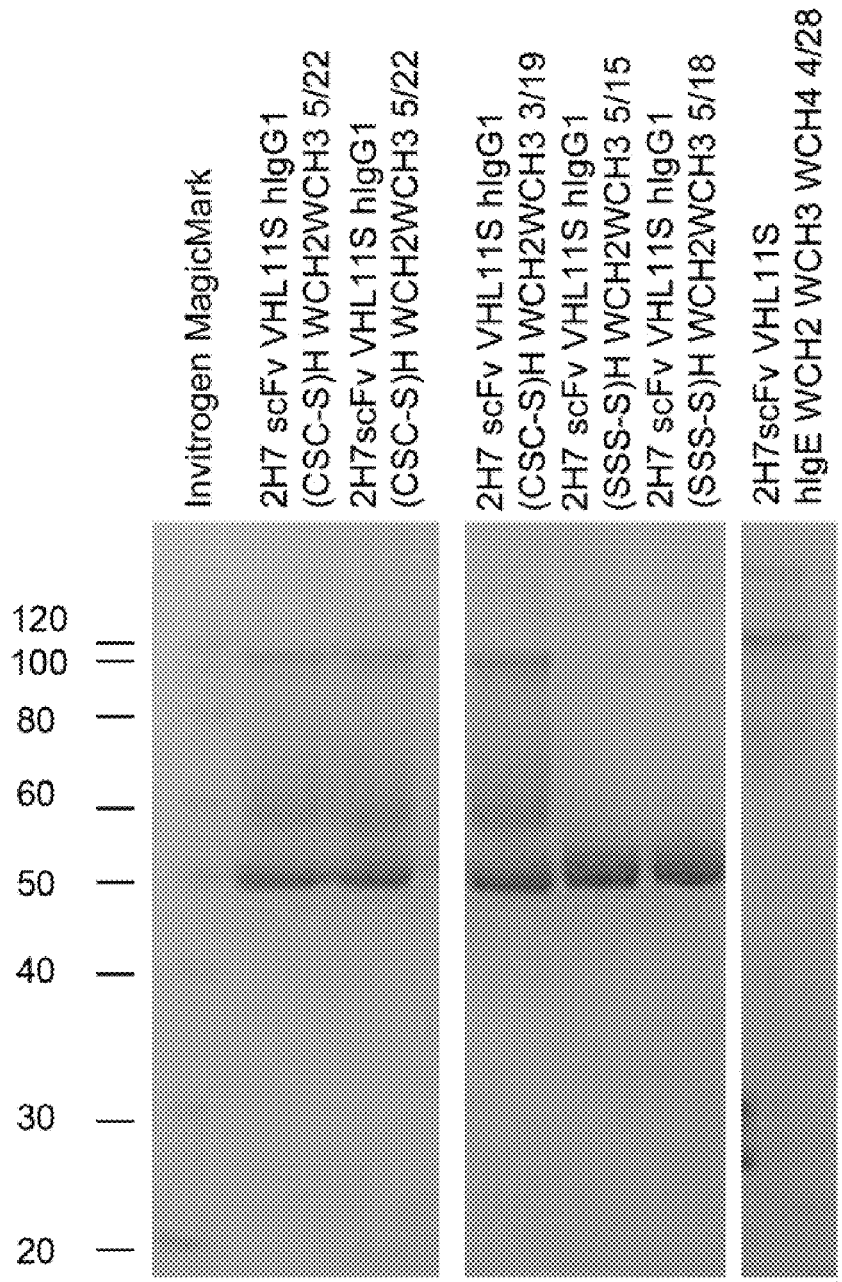

FIG. 65 shows a nonreducing SDS-PAGE analysis examining 10 μg (per lane) of various purified 2H7 V$_H$L11S scFv Ig constructs of the invention, indicating an apparent molecular weight for each construct in reference to a standard molecular weight marker in lane 1. See Example 41.

Figure 66:
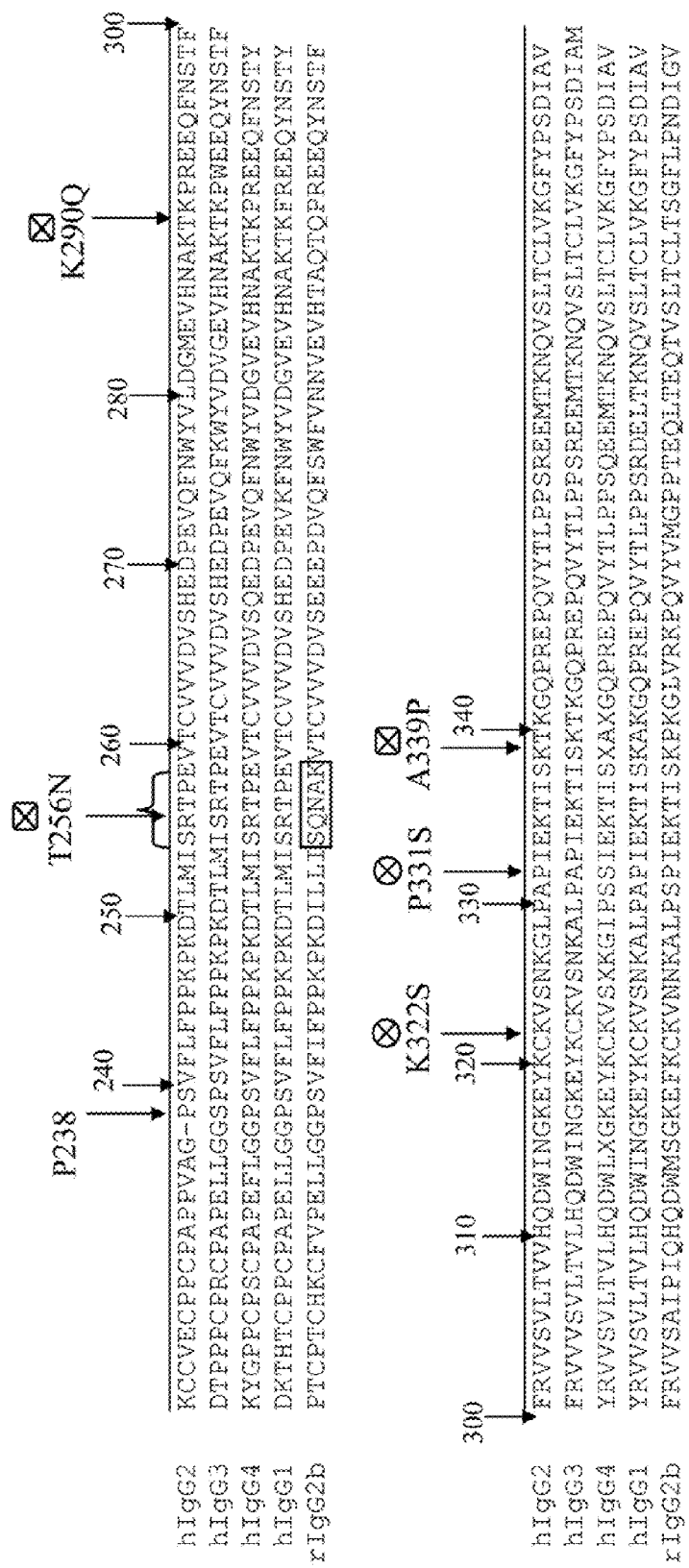

FIG. 66 compares the CH2 domain sequences of four different human IgG regions, hIgG1, hIgG2, hIgG3, hIgG4, hIgG4, and one rat region, rIgG2b (SEQ ID NOs:694-698). Point mutations affecting ADCC and CDC are labeled with arrows. See Example 52.

Figure 67:
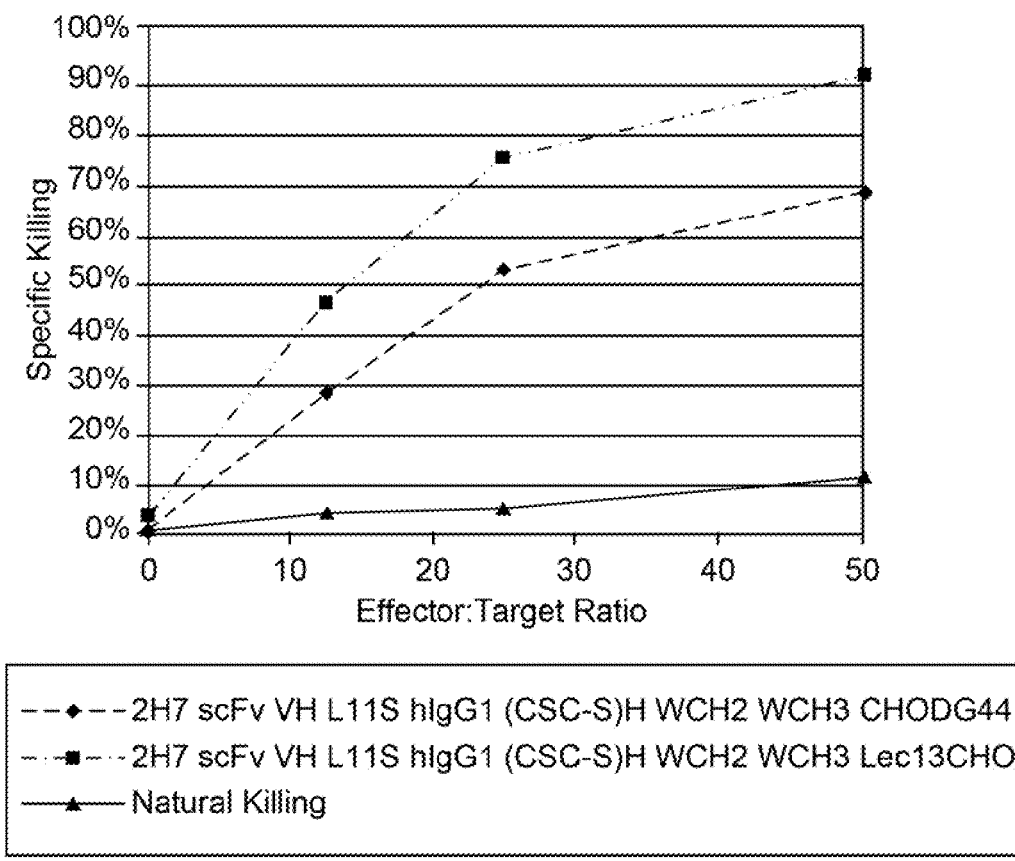

FIG. 67 demonstrates the ability of various 2H7 V$_H$L11S scFv Ig constructs to mediate ADCC in CHO and Lec13 CHO transiently transfected cells, indicating that constructs expressed in Lec 13 CHO cells had a 20% increase in specific killing over the same construct expressed in regular CHO cells. See Example 42.

Figure 68:
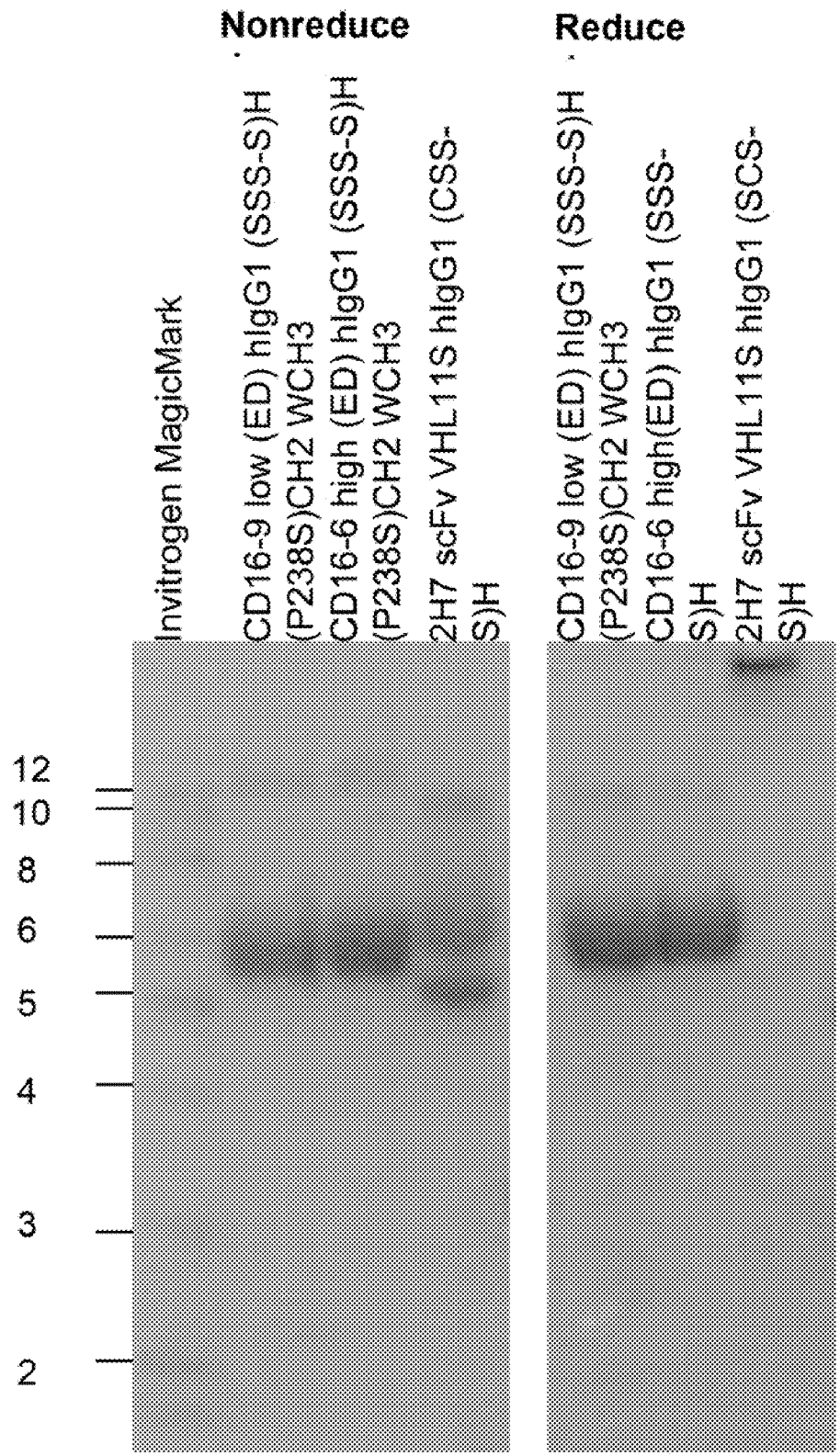

FIG. 68 shows SDS-PAGE analysis, both reduced and non-reduced, of high and low affinity alleles of soluble CD 16(ED) (SSS-S)H P283S CH2 WCH3 (SEQ ID NOs:422 and 426). See Example 43.

Figure 69:
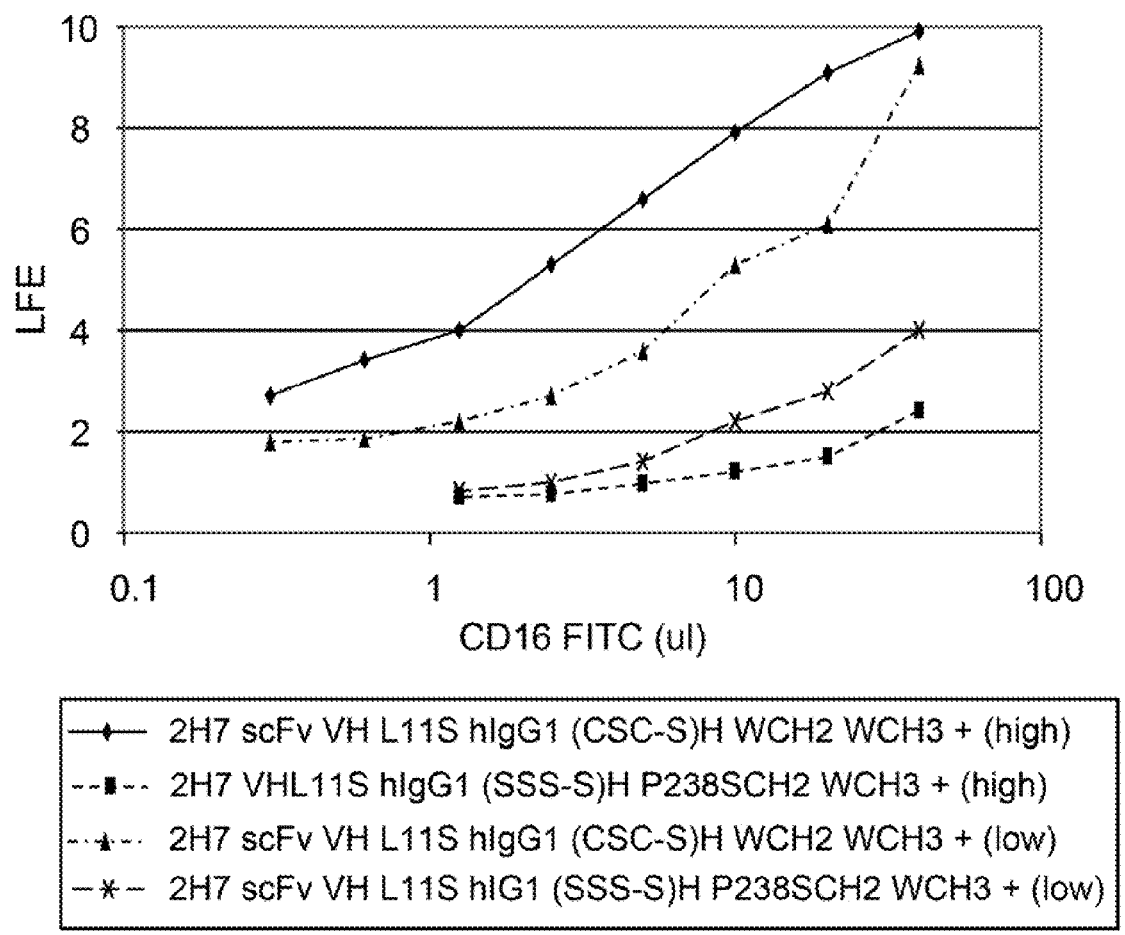

FIG. 69 demonstrates the different binding capabilities of the high and low affinity CD16 fusion proteins to 2H7 V$_H$ L11S scFv (CSC-S) WCH2 WCH3 or 2H7 V$_H$ L11S scFv (SSS-S) WCH2 WCH3, and indicates a loss of high and low affinity allele binding using P238S CH2 constructs. See Example 43.

FIG. 70 shows a diagram of (A) an assay used to detect changes in Fc receptor binding using FITC conjugated CD16 extracellular domain Ig fusion protein with a mutated tail, which eliminates self-association and B) a mammalian display system using cell surface expression of constructs. See Example 44.

FIG. 71 shows the induction of apoptosis in Bjab and Ramos cells by various mAbs and scFvIg constructs of the invention. See Example 45.

Figure 72:
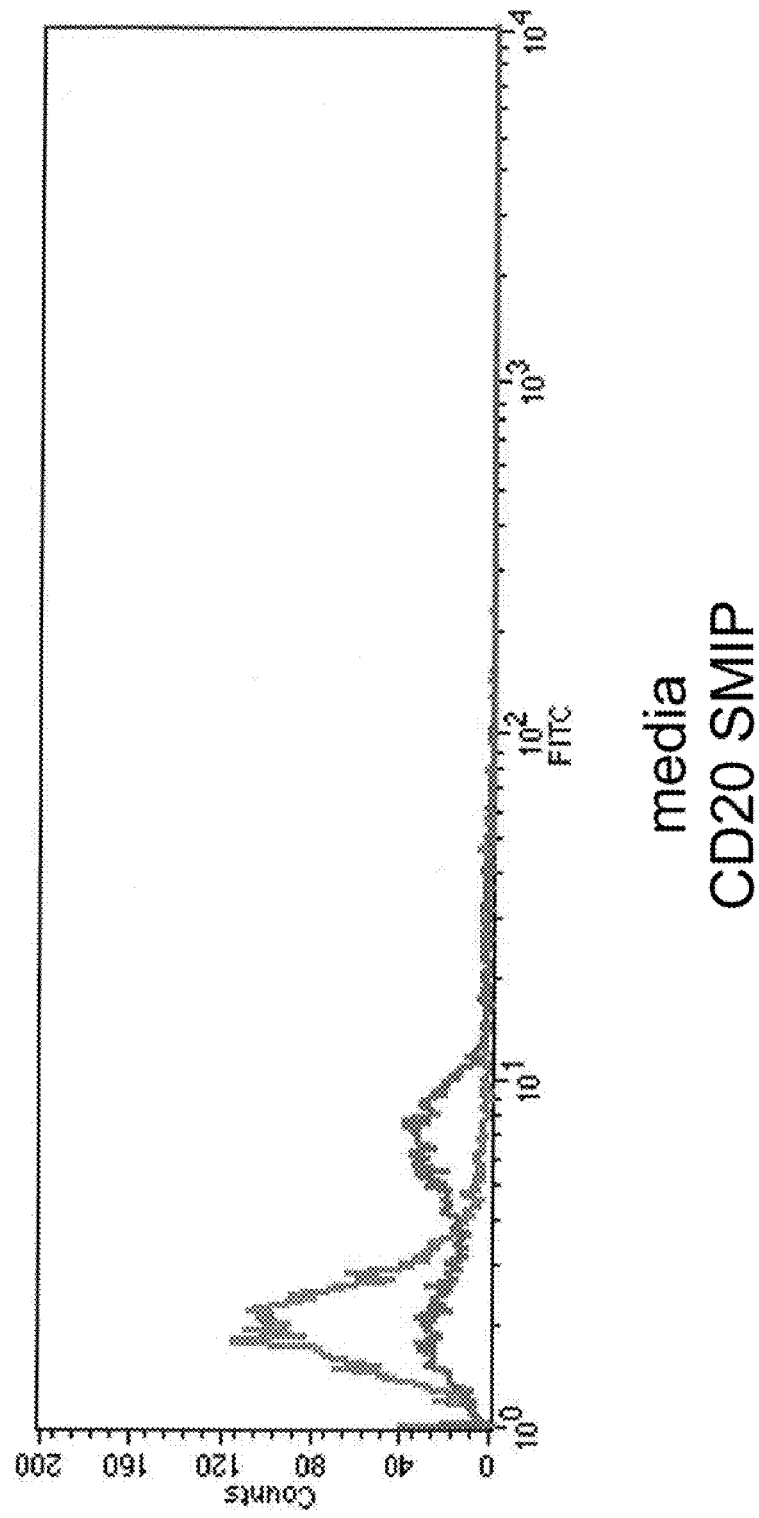

FIG. 72 illustrates the ability of 2H7 scFv (SSS-S) H WCH2 WCH3 and 2H7 scFv (SSS-S) H P238CH2 WCH3 constructs to induce apoptosis in Ramos cells that is mediated by activation of caspase 3. The results indicate that under these conditions, both constructs bind CD20 and induced apoptosis.

FIG. 73 illustrates the ability of 2H7 scFv (SSS-S) H WCH2 WCH3 and 2H7 scFv (SSS-S) H P238CH2 WCH3 constructs to mediate CDC activity in CD20 positive Bjab target cells. The results indicate both constructs had the ability to mediate CDC.

Figure 74:
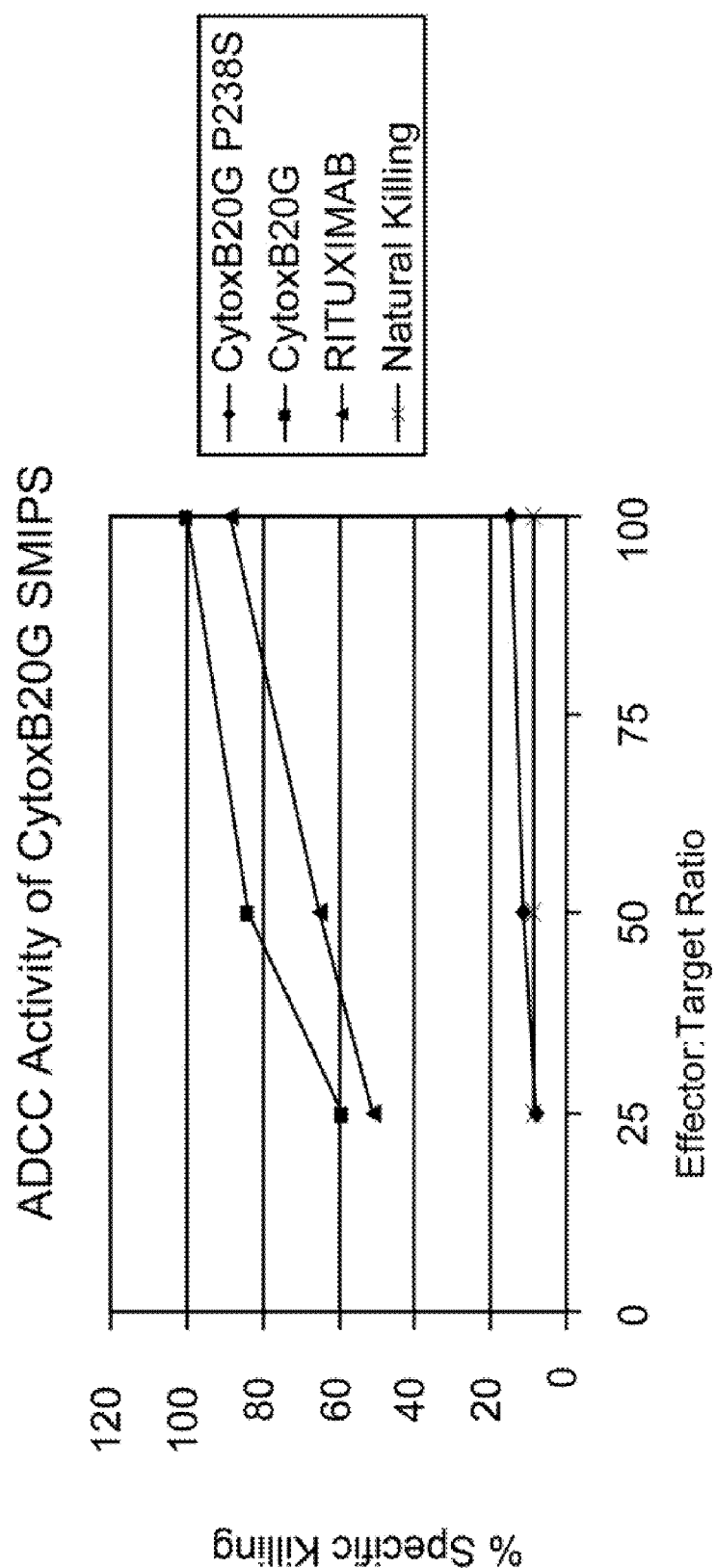

FIG. 74 compares the ability of 2H7 scFv (SSS-S) H WCH2 WCH3 and 2H7 scFv (SSS-S) H P238CH2 WCH3 constructs to mediate ADCC in Bjab target cells. The results indicate the 2H7 scFv (SSS-S) H WCH2 WCH3 construct was very effective and induced high levels of specific killing, while the of 2H7 scFv (SSS-S) H P238CH2 WCH3 construct was not effective in mediating ADCC.

Figure 75:
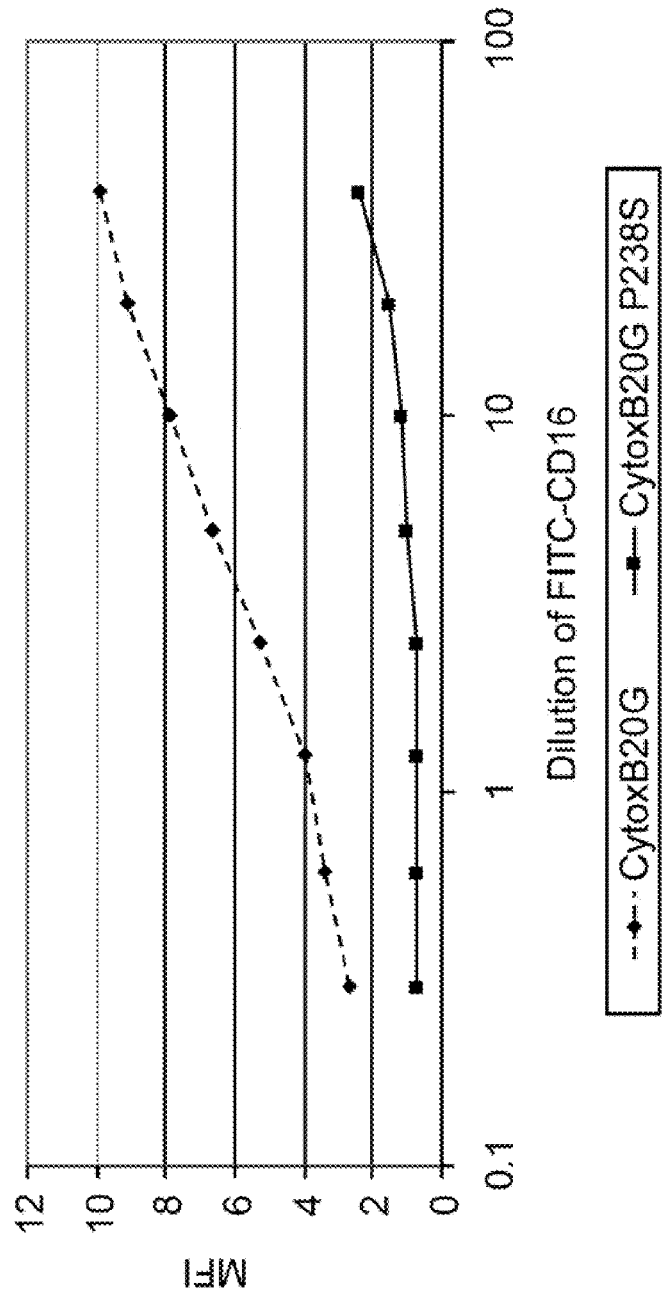

FIG. 75 compares the ability of 2H7 scFv (SSS-S) H WCH2 WCH3 and 2H7 scFv (SSS-S) H P238CH2 WCH3 constructs to bind soluble CD16 (high affinity and low affinity forms) in CD20 positive CHO cells. Results indicate that 2H7 scFv (SSS-S) H WCH2 WCH3 was able to bind CD16 (both forms), while 2H7 scFv (SSS-S) H P238CH2 WCH3 was not able to bind CD16 (either form).

Figure 76:
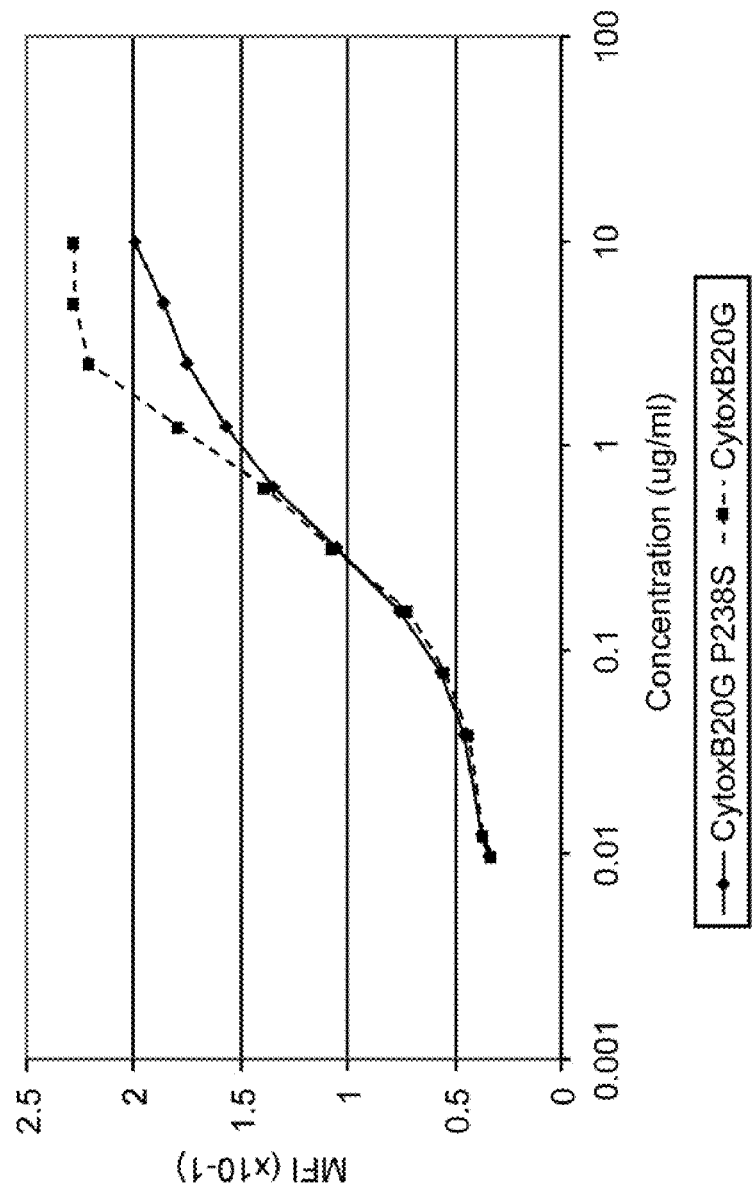

FIG. 76 compares the ability of 2H7 scFv (SSS-S) H WCH2 WCH3 and 2H7 scFv (SSS-S) H P238CH2 WCH3 constructs to bind CD64 positive U937 cells. The results indicate that both constructs had high affinity for FcγRI, and that the P238S mutation selectively reduced binding to FcγRIII.

Figure 77:
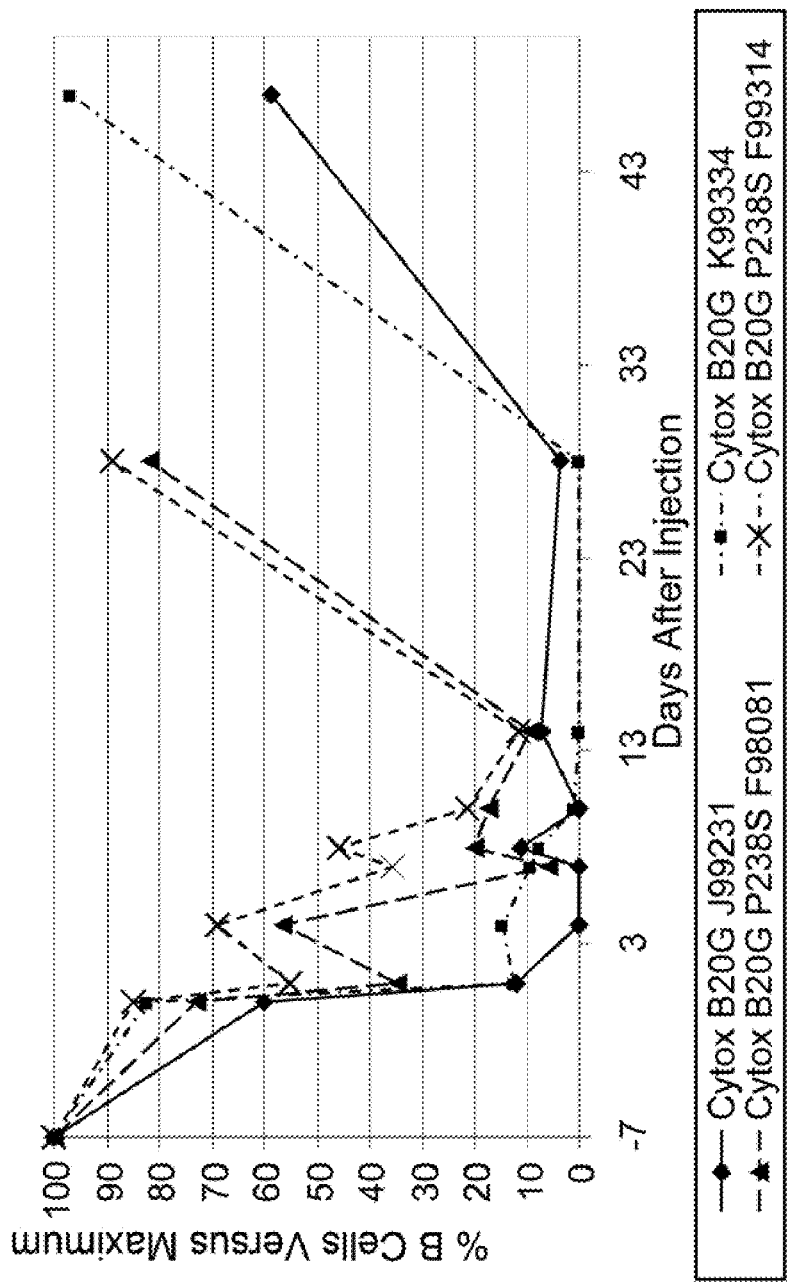

FIG. 77 illustrates an in vivo experiment in macaques to measure the effect of where 2H7 scFv (SSS-S) H WCH2 WCH3 and 2H7 scFv (SSS-S) H P238CH2 WCH3 constructs on B cell depletion. The constructs were administered one week apart and B cells were measures on days –7, 0, 1, 3, 7, 8, 10, 14, 28 and 43 using complete blood counts and two-color flow cytometry. The results indicate that the 2H7 scFv (SSS-S) H WCH2 WCH3 construct resulted in rapid and complete depletion of B cells, which lasted up to 28 days after the second injection. Conversely the 2H7 scFv (SSS-S) H P238CH2 WCH3 construct resulted in a slow reduction in B cells to about 50% in the first 2 weeks; however, B cells rapidly began to return to regular level shortly after this. This suggests that ADCC mediated by CD16 interaction is likely necessary for rapid and sustained B cell depletion.

Figure 78:
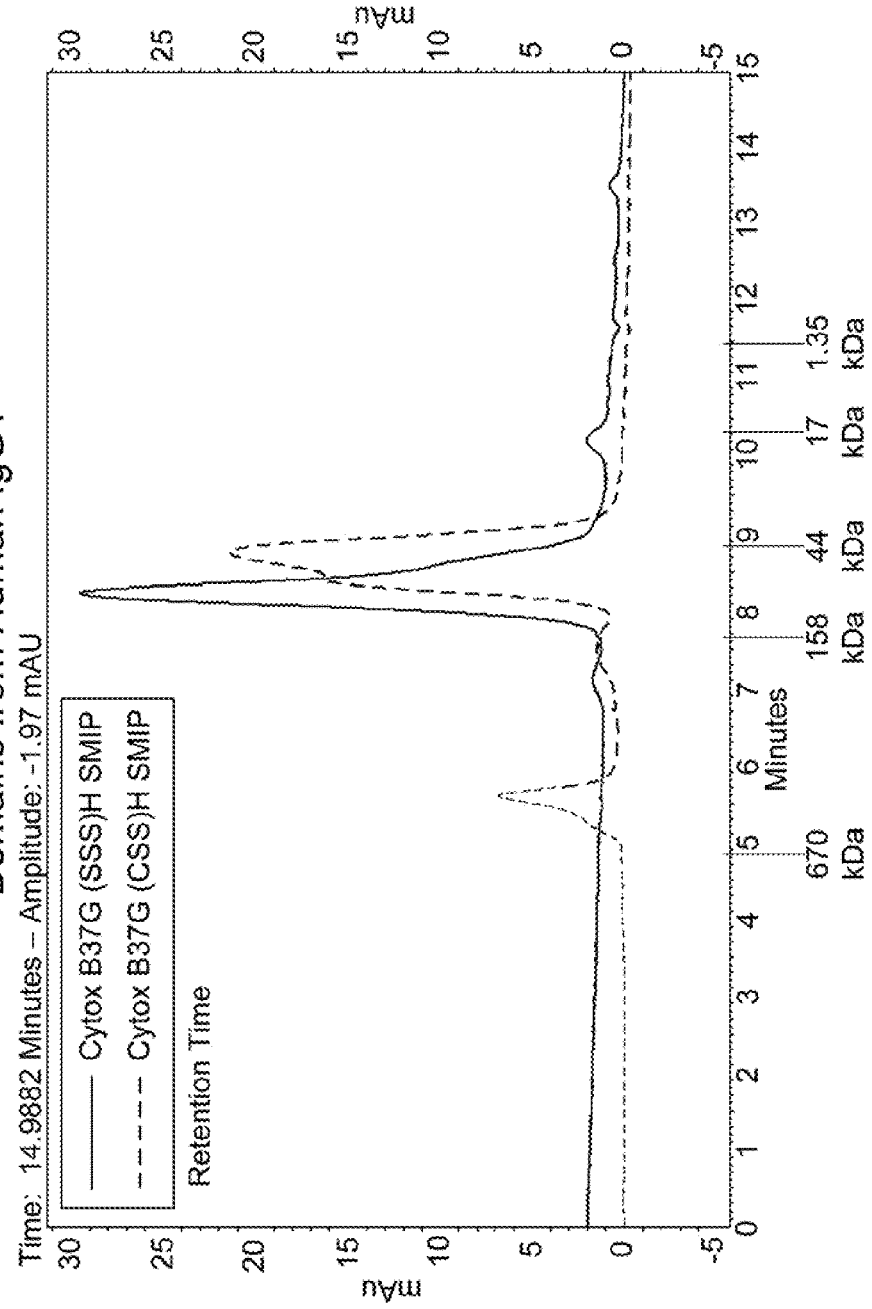

FIG. 78 illustrates the SEC profiles of G28-1 VL11S scFv (SSS) H WCH2 WCH3 and G28-1 VL11S scFv (SSC) H WCH2 WCH3 constructs. The construct with an SSS hinge generated a single uniform peak at approximately 75-100 Kd, while the construct with a SSC hinge generated a smaller form and other heterogeneous forms, including one at greater than 200 Kd.

FIG. 79 illustrates the binding ability of G28-1 VL11S scFv (SSS) H WCH2 WCH3 and G28-1 VL11S scFv (SSC) H WCH2 WCH3 constructs in B cell lymphoma cells: Bjab, Ramos, WIL-2, Namalwa and Raji. The results in (a) indicate that G28-1 VL11S scFv (SSS) H WCH2 WCH3 bound to Bjab and Ramos cells, and moderately to WIL-2 cells, and at lower levels to Namalwa and Raji cells. The results in (b) indicate the G28-1 VL11S scFv (SSC) H WCH2 WCH3 bound to Bjab cells, and moderately to and Ramos and WIL-2 cells, and at lower levels to Namalwa and Raji cells.

Figure 80:
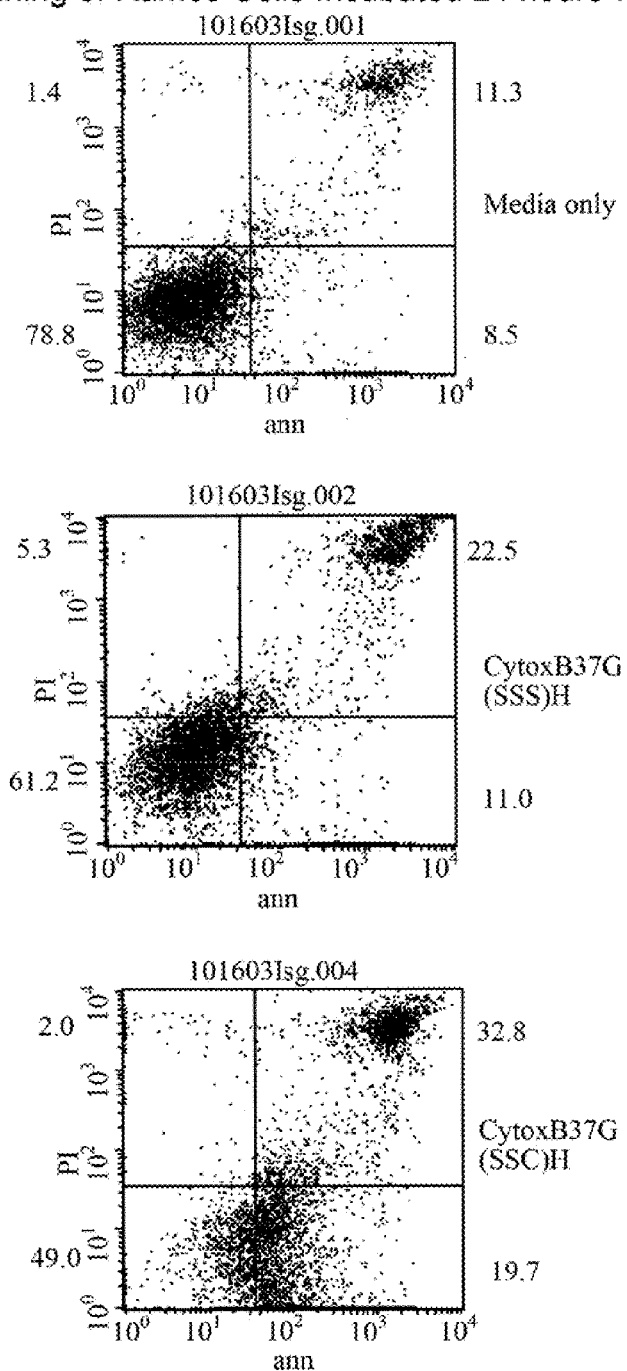

FIG. 80 illustrates annexin and v-propidium iodide binding in Ramos cells incubated with G28-1 VL11S scFv (SSS) H WCH2 WCH3 and G28-1 VL11S scFv (SSC) H WCH2 WCH3 constructs overnight. The results indicate that both constructs induced apoptosis; however, the construct with the (SSC) hinge induced more apoptosis than the construct with the (SSS) hinge.

Figure 81:
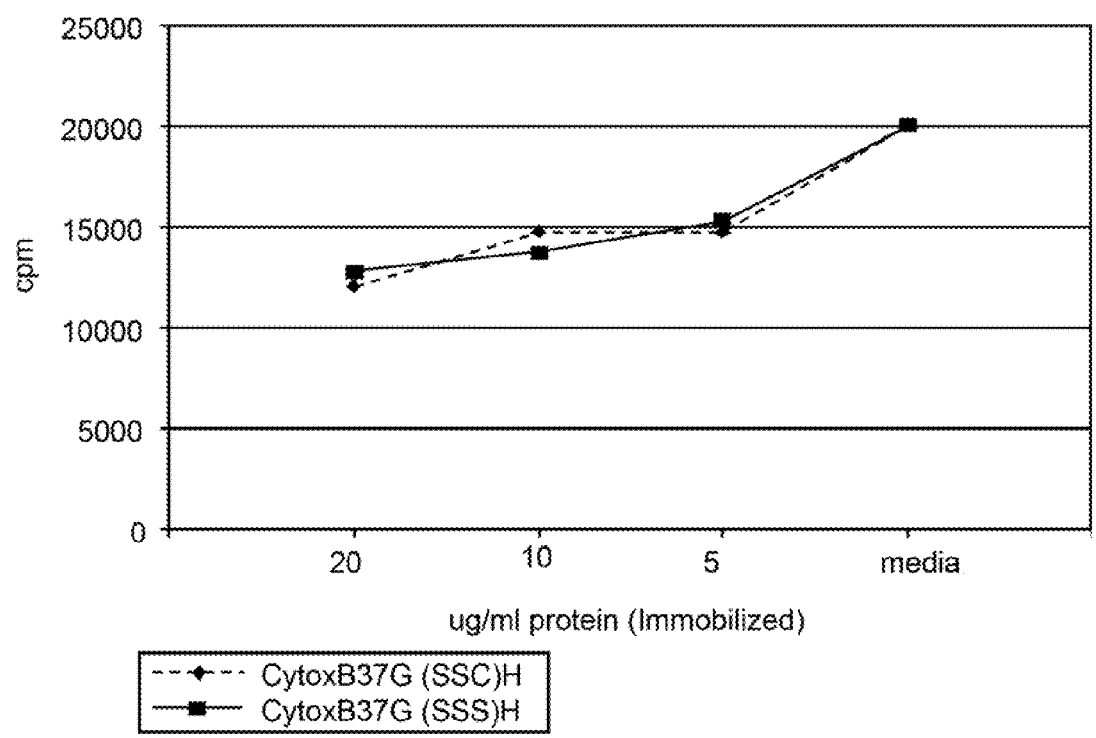

FIG. 81 illustrates the ability of G28-1 VL11S scFv (SSS) H WCH2 WCH3 and G28-1 VL11S scFv (SSC) H WCH2 WCH3 constructs to inhibit proliferation of Ramos cells. The results indicate that both constructs inhibited proliferation.

Figure 82:
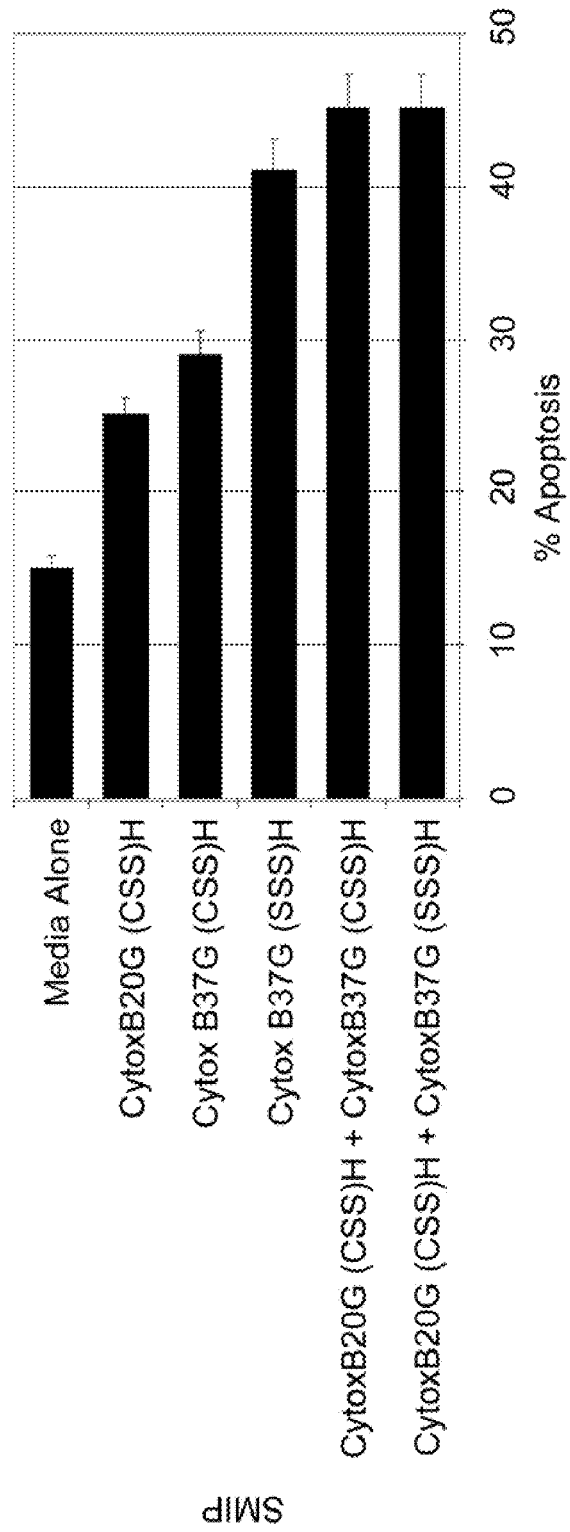

FIG. 82 illustrates the ability of G28-1 VL11S scFv (SSS) H WCH2 WCH3 and G28-1 VL11S scFv (SSC) H WCH2 WCH3 and 2H7 scFv (CSS) H WCH2 WCH3 constructs to induce apoptosis in Ramos B cells, alone and in different combinations. The results shown in this experiment indicate that the both G28-1 constructs were more efficient than the 2H7 construct. The results also indicate that the G28-1 VL11S scFv (SSS) H WCH2 WCH3 construct was more efficient than the G28-1 VL11S scFv (SSC) H WCH2 WCH3 construct. However, the amount of apoptosis was greatest when the 2H7 and the G28-1 constructs were used in combination.

Figure 83:
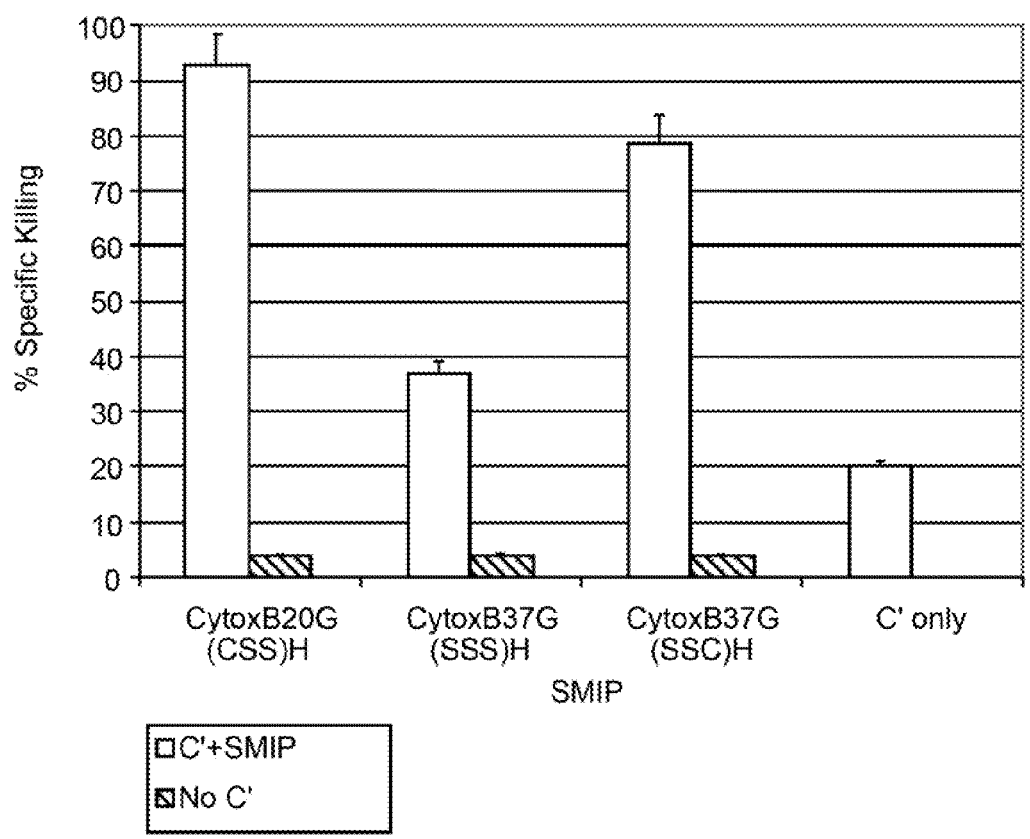

FIG. 83 compares the ability of G28-1 VL11S scFv (SSS) H WCH2 WCH3, G28-1 VL11S scFv (SSC) H WCH2 WCH3 and 2H7 scFv (CSS) H WCH2 WCH3 constructs to mediate CDC in Ramos B cells. The results indicate that all the constructs mediated CDC. The 2H7 construct was the most efficient, followed by G28-1 VL11S scFv (SSC) H WCH2 WCH3, then G28-1 VL11S scFv (SSS) H WCH2 WCH3.

Figure 84:
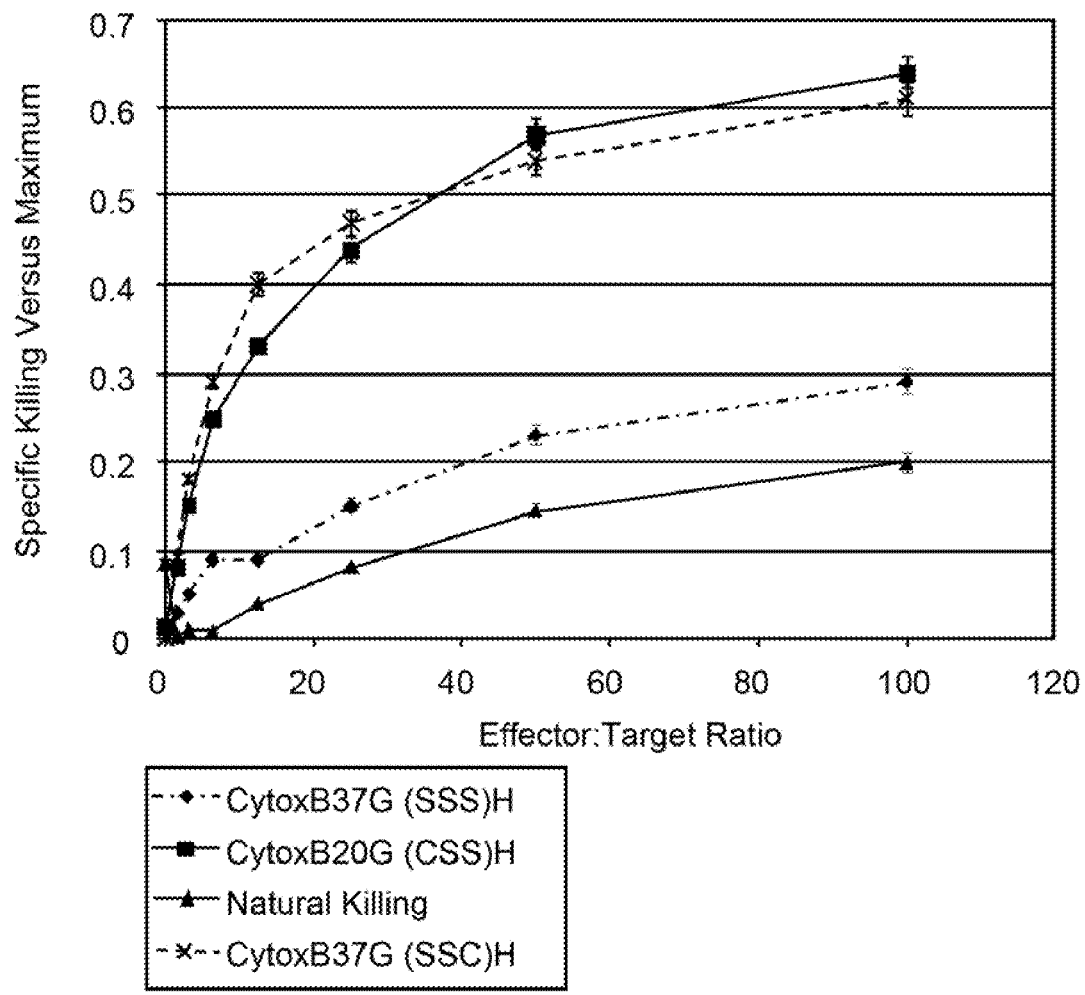

FIG. 84 compares the ability of the G28-1 VL11S scFv (SSS) H WCH2 WCH3, G28-1 VL11S scFv (SSC) H WCH2 WCH3 and 2H7 scFv (CSS) H WCH2 WCH3 constructs to mediate ADCC in Ramos B cells. The results indicate that the G28-1 VL11S scFv (SSS) H WCH2 WCH3 and G28-1 VL11S scFv (SSC) H WCH2 WCH3 constructs were able to mediate ADCC, while the 2H7 scFv (CSS) H WCH2 WCH3 construct ability to mediate ADCC was lower, but still higher than the level of natural killing.

DETAILED DESCRIPTION OF THE INVENTION

The present invention is directed to novel molecules useful, for example, as therapeutics, as well as for other purposes including diagnostic and research purposes. Such molecules have, for example, antigen binding or other binding function(s) and, for example, one or more effector functions. The invention includes molecular constructs, including binding domain-immunoglobulin fusion proteins, and related compositions and methods, which will be useful in immunotherapeutic and immunodiagnostic applications, and in research methods, and which offer certain advantages over antigen-specific compounds and polypeptides of the prior art. The constructs, including fusion proteins, of the present invention are preferably single polypeptide chains that comprise, in pertinent part, the following fused or otherwise connected domains or regions: a binding region construct, such as a binding domain or polypeptide, a connecting region construct including, for example, a native or engineered immunoglobulin hinge region polypeptide, and a tail region construct, including, for example, a construct that may comprise, consist essentially of, or consist of, a native or engineered immunoglobulin heavy chain CH2 constant region polypeptide and a native or engineered immunoglobulin heavy chain CH3 constant region polypeptide. According to certain embodiments that are particularly useful for gene therapy, the constructs, including fusion proteins, of the present invention may further comprise a native or engineered plasma membrane anchor domain. According to certain other preferred embodiments the constructs, including fusion proteins, of the present invention may further include a tail region having a native or engineered immunoglobulin heavy chain CH4 constant region polypeptide. In particularly preferred embodiments, the binding regions, such as polypeptide domains, of which the constructs, including binding domain-immunoglobulin fusion proteins, are comprised are, or are derived from, polypeptides that are the products of human gene sequences, but the invention need not be so limited and may in fact relate to constructs, including binding domain-immunoglobulin fusion proteins, as provided herein that are derived from any natural or artificial source, including genetically engineered and/or mutated polypeptides.

The present invention relates in part to the surprising observation that the novel constructs, including binding domain-immunoglobulin fusion proteins, described herein are capable of immunological activity. More specifically, these proteins retain the ability to participate in well known immunological effector activities including, for example, antibody dependent cell mediated cytotoxicity (e.g., subsequent to antigen binding on a cell surface, engagement and induction of cytotoxic effector cells bearing appropriate Fc receptors, such as Natural Killer cells bearing FcγIII, under appropriate conditions) and/or complement fixation in complement dependent cytotoxicity (e.g., subsequent to antigen binding on a cell surface, recruitment and activation of cytolytic proteins that are components of the blood complement cascade) despite having structures not be expected to be capable of promoting such effector activities or to promtion of such activities as described herein. For reviews of ADCC and CDC see, e.g., Carter, 2001 *Nat. Rev. Canc.* 1:118; Sulica et al., 2001 *Int. Rev. Immunol.* 20:371; Maloney et al., 2002 *Semin. Oncol.* 29:2; Sondel et al., 2001 *Hematol Oncol Clin North Am* 15(4):703-21; Maloney 2001 *Anticanc. Drugs* 12 Suppl.2:1-4. IgA activation of complement by the alternative pathway is described, for example, in Schneiderman et al., 1990 *J. Immunol.* 145:233. As described in greater detail below, ADCC, complement fixation, and CDC are unexpected functions for constructs, including fusion proteins, comprising for example immunoglobulin heavy chain regions and having the structures described herein, and in particular for immunoglobulin fusion proteins comprising, for example, immunoglobulin hinge region polypeptides that are compromised in their ability to form interchain, homodimeric disulfide bonds.

Another advantage afforded by the present invention is constructs, including binding domain-immunoglobulin fusion polypeptides, of the invention that can be produced in substantial quantities that are typically greater than those routinely attained with single-chain antibody constructs of the prior art, for example. In preferred embodiments, constructs, including the binding domain-immunoglobulin fusion polypeptides, of the present invention are recombinantly expressed in mammalian or other desired and useful expression systems, which offer the advantage of providing polypeptides that are stable in vivo (e.g., under physiological conditions). According to non-limiting theory, such stability may derive in part from posttranslational modifications, and specifically glycosylation. Production of the constructs, including binding domain-immunoglobulin fusion protein constructs, of the invention via recombinant mammalian expression has been attained in static cell cultures at a level of greater than 50 mg protein per liter culture supernatant and has been routinely observed in such cultures at 10-50 mg/liter, such that preferably at least 10-50 mg/liter may be produced under static culture conditions; also contemplated are enhanced production, in whole or in part, of the protein constructs of the invention using art-accepted scale-up methodologies such as "fed batch" (i.e., non-static) production, where yields of at least 5-500 mg/l, and in some instances at least 0.5-1 gm/l, depending on the particular protein product, are obtained.

A construct, including a binding domain polypeptide, according to the present invention may be, for example, any polypeptide that possesses the ability to specifically recognize and bind to a cognate biological molecule or complex of more than one molecule or assembly or aggregate, whether stable or transient, of such a molecule. Such molecules include proteins, polypeptides, peptides, amino acids, or derivatives thereof; lipids, fatty acids or the like, or derivatives thereof; carbohydrates, saccharides or the like or derivatives thereof; nucleic acids, nucleotides, nucleosides, purines, pyrimidines or related molecules, or derivatives thereof, or the like; or any combination thereof such as, for example, glycoproteins, glycopeptides, glycolipids, lipoproteins, proteolipids; or any other biological molecule that may be present in a biological sample. Biological samples may be provided, for example, by obtaining a blood sample, biopsy specimen, tissue explant, organ culture, biological fluid or any other tissue or cell or other preparation from a subject or a biological source. The subject or biological source may, for example, be a human or non-human animal, a primary cell culture or culture adapted cell line including but not limited to genetically engineered cell lines that may contain chromosomally integrated or episomal recombinant nucleic acid sequences, immortalized or immortalizable cell lines, somatic cell hybrid cell lines, differentiated or differentiatable cell lines, transformed cell lines and the like, etc. In certain preferred embodiments of the invention, the subject or biological source may be suspected of having or being at risk for having a disease, disorder or condition, including a malignant disease, disorder or condition or a B cell disorder, which in certain further embodiments may be an autoimmune disease, and in certain other embodiments of the invention the subject or biological source may be known to be free of a risk or presence of such disease, disorder or condition.

A binding region, including a binding domain polypeptide, for example, may be any naturally occurring, synthetic, semi-synthetic, and/or recombinantly produced binding partner for a biological or other molecule that is a target structure of interest, herein sometimes referred to as an "antigen" but intended according to the present disclosure to encompass any target biological or other molecule to which it is desirable to have the subject invention, for example, a fusion protein, bind or specifically bind. Constructs of the invention, including binding domain-immunoglobulin fusion proteins, are defined to be "immunospecific" or capable of binding to a desired degree, including specifically binding, if they bind a desired target molecule such as an antigen as provided herein, at a desired level, for example, with a $K_a$ of greater than or equal to about $10^4$ $M^{-1}$, preferably of greater than or equal to about $10^5$ $M^{-1}$, more preferably of greater than or equal to about $10^6$ $M^{-1}$ and still more preferably of greater than or equal to about $10^7$ $M^{-1}$. Affinities of even greater than about $10^7$ $M^{-1}$ are still more preferred, such as affinities equal to or greater than about $10^7$ $M^{-1}$, about $10^8$ $M^{-1}$, and about $10^9$ $M^{-1}$, and about $10^{10}$ $M^{-1}$. Affinities of binding domain-immunoglobulin fusion proteins according to the present invention can be readily determined using conventional techniques, for example those described by Scatchard et al., 1949 *Ann. N.Y. Acad. Sci.* 51:660. Such determination of fusion protein binding to target antigens of interest can also be performed using any of a number of known methods for identifying and obtaining proteins that specifically interact with other proteins or polypeptides, for example, a yeast two-hybrid screening system such as that described in U.S. Pat. No. 5,283,173 and U.S. Pat. No. 5,468,614, or the equivalent.

Preferred embodiments of the subject invention constructs, for example, binding domain-immunoglobulin fusion proteins, comprise binding regions or binding domains that may include, for example, at least one native or engineered immunoglobulin variable region polypeptide, such as all or a portion or fragment of a native or engineered heavy chain and/or a native or engineered light chain V-region, provided it is capable of binding or specifically binding an antigen or other desired target structure of interest at a desired level of binding and selectivity. In other preferred embodiments the binding region or binding domain comprises, consists essentially of, or consists of, a single chain immunoglobulin-derived Fv product, for example, and scFv, which may include all or a portion of at least one native or engineered immunoglobulin light chain V-region and all or a portion of at least one native or engineered immunoglobulin heavy chain V-region, and a linker fused or otherwise connected to the V-regions; preparation and testing such constructs are described in greater detail herein. Other preparation and testing methods are well known in the art.

As described herein and known in the art, immunoglobulins comprise products of a gene family the members of which exhibit a high degree of sequence conservation. Amino acid sequences of two or more immunoglobulins or immunoglobulin domains or regions or portions thereof (e.g., $V_H$ domains, $V_L$ domains, hinge regions, CH2 constant regions, CH3 constant regions) may be aligned and analyzed. Portions of sequences that correspond to one another may be identified, for instance, by sequence homology. Determination of sequence homology may be determined with any of a number of sequence alignment and analysis tools, including computer algorithms well known to those of ordinary skill in the art, such as Align or the BLAST algorithm (Altschul, 1991 *J. Mol. Biol.* 219:555-565; Henikoff and Henikoff, 1992 *Proc. Natl. Acad. Sci. USA* 89:10915-10919), which is available at the NCBI website (http://www/ncbi.nlm.nih.gov/cgi-bin/BLAST). Default parameters may be used.

Portions, for example, of a particular immunoglobulin reference sequence and of any one or more additional immunoglobulin sequences of interest that may be compared to a reference sequence. "Corresponding" sequences, regions, fragments or the like, may be identified based on the convention for numbering immunoglobulin amino acid positions according to Kabat, *Sequences of Proteins of Immunological Interest*, ($5^{th}$ ed. Bethesda, Md.: Public Health Service, National Institutes of Health (1991)). For example, according to this convention, the immunoglobulin family to which an immunoglobulin sequence of interest belongs is determined based on conservation of variable region polypeptide sequence invariant amino acid residues, to identify a particular numbering system for the immunoglobulin family, and the sequence(s) of interest can then be aligned to assign sequence position numbers to the individual amino acids which comprise such sequence(s). Preferably at least about 70%, more preferably at least about 80%-85% or about 86%-89%, and still more preferably at least about 90%, about 92%, about 94%, about 96%, about 98% or about 99% of the amino acids in a given amino acid sequence of at least about 1000, more preferably about 700-950, more preferably about 350-700, still more preferably about 100-350, still more preferably about 80-100, about 70-80, about 60-70, about 50-60, about 40-50 or about 30-40 consecutive amino acids of a sequence, are identical to the amino acids located at corresponding positions in a reference sequence such as those disclosed by Kabat (1991) or in a similar compendium of related immunoglobulin sequences, such as may be generated from public databases (e.g., Genbank, SwissProt, etc.) using sequence alignment tools such as, for example, those described above. In certain preferred embodiments, an immunoglobulin sequence of interest or a region, portion, derivative or fragment thereof is greater than about 95% identical to a corresponding reference sequence, and in certain preferred embodiments such a sequence of interest may differ from a corresponding reference at no more than about 1, 2, 3, 4, 5, 6, 7, 8, 9 or 10 amino acid positions.

For example, in certain embodiments the present invention is directed to a construct, including a binding domain-immunoglobulin fusion protein, comprising in pertinent part a human or other species immunoglobulin heavy chain variable region polypeptide comprising a mutation, alteration or deletion at an amino acid at a location or locations corresponding to one or more of amino acid positions 9, 10, 11, 12, 108, 110, 111, and 112 in, for example, SEQ ID NO:212, which comprises, for example, a murine $V_H$-derived sequence. At a relatively limited number of immunoglobulin $V_H$ sequence positions, for example, including position 11, amino acid conservation is observed in the overwhelming majority of $V_H$ sequences analyzed across mammalian species lines (e.g., Leu11, Va137, Gly44, Leu45, Trp47; Nguyen et al., 1998 *J. Mol. Biol.* 275:413). Various such amino acid residues, and hence their side chains, are located at the surface of the variable domain ($V_H$). They may contact residues of the $C_H1$ (e.g., Leu11) and the $V_L$ domains (e.g., Va137, Gly44, Leu45, and Trp47) and may, in the absence of light chains, contribute to stability and solubility of the protein (see, e.g., Chothia et al., 1985 *J. Mol. Biol.* 186:651; Muyldermans et al., 1994 *Prot. Engineer.* 7:1129; Desmyter et al., 1996 *Nat. Struct. Biol.* 3:803; Davies et al., 1994 *FEES Lett.* 339:285). In certain embodiments, for example, the present invention is also directed to a construct, including a binding domain-immunoglobulin fusion protein, comprising in pertinent part a human immunoglobulin light chain variable region polypeptide, or an immunoglobulin light chain variable region polypeptide from another species, comprising a mutation, alteration or deletion at an amino acid at a location or locations corresponding to one or more of amino acid positions 12, 80, 81, 82, 83, 105, 106, 107 and 108. In still other certain embodiments, for example, the present invention is directed to a construct, including a binding domain-immunoglobulin fusion protein, comprising in pertinent part (1) a human immunoglobulin heavy chain variable region polypeptide, or an immunoglobulin light chain variable region polypeptide from another species, comprising, consisting essentially of, or consisting of, said heavy chain sequence having a mutation, alteration or deletion at a location or locations corresponding to one or more of amino acid positions 9, 10, 11, 12, 108, 110, 111, and 112, and (2) a human immunoglobulin light chain variable region polypeptide, or an immunoglobulin light chain variable region polypeptide from another species, comprising, consisting essentially of, or consisting of, said light chain sequence having a mutation, alteration or deletion at a location or locations corresponding to one or more of amino acid positions 12, 80, 81, 82, 83, 105, 106, 107 and 108.

As another example, by reference to immunoglobulin sequence compendia and databases such as those cited above, for example, the relatedness of two or more immunoglobulin sequences to each other can readily and without undue experimentation be established in a manner that permits identification of the animal species of origin, the class and subclass (e.g., isotype) of a particular immunoglobulin or immunoglobulin region polypeptide sequence. Any immunoglobulin variable region polypeptide sequence, including native or engineered $V_H$ and/or $V_L$ and/or single-chain variable region (sFv) sequences or other native or engineered V region-derived sequences or the like, may be used as a binding region or binding domain. Engineered sequences includes immunoglobulin sequences from any species, preferably human or mouse, for example, that include, for example, a mutation, alteration or deletion at an amino acid at a location or locations corresponding to one or more of amino acid positions 9, 10, 11, 12, 108, 110, 111, and 112 in a heavy chain variable region sequence or an scFv, and/or a mutation, alteration or deletion at a location or locations corresponding to one or more of amino acid positions 12, 80, 81, 82, 83, 105, 106, 107 and 108 in a light chain variable region sequence or an scFv.

Various preferred embodiments include, for example, native or engineered immunoglobulin V region polypeptide sequences derived, for example, from antibodies including monoclonal antibodies such as murine or other rodent antibodies, or antibodies or monoclonal antibodies derived from other sources such as goat, rabbit, equine, bovine, camelid or other species, including transgenic animals, and also including human or humanized antibodies or monoclonal antibodies. Non-limiting examples include variable region polypeptide sequences derived from monoclonal antibodies such as those referenced herein and/or described in greater detail in the Examples below, for instance, CD20-binding or specific murine monoclonal antibodies (e.g., 2H7), other CD20-binding or specific murine monoclonal antibodies that are not 1F5 antibodies, monoclonal antibody L6 (specific for a carbohydrate-defined epitope and available from American Type Culture Collection, Manassas, Va., as hybridoma HB8677), and monoclonal antibodies that bind to or are specific for CD28 (e.g., monoclonal antibody 2E12), CD40, CD80, CD137 (e.g., monoclonal antibody 5B9 or monoclonal antibody 1D8 which recognizes the murine homologue of CD137, 41BB) and CD152 (CTLA-4).

Other binding regions, including binding domain polypeptides, may comprise any protein or portion thereof that retains the ability to bind or specifically bind to an antigen as provided herein, including non-immunoglobulins. Accordingly the invention contemplates constructs, including fusion proteins, comprising binding region or binding domain polypeptides that are derived from polypeptide ligands such as hormones, cytokines, chemokines, and the like; cell surface or soluble receptors for such polypeptide ligands; lectins; intercellular adhesion receptors such as specific leukocyte integrins, selectins, immunoglobulin gene superfamily members, intercellular adhesion molecules (ICAM-1, -2, -3) and the like; histocompatibility antigens; etc.

Examples of cell surface receptors useful in the preparation of, or as, binding regions, or that may provide a binding domain polypeptide, and that may also be selected as a target molecule or antigen to which a construct, including for example, a binding domain-Ig fusion protein of the present invention desirably binds, include the following, or the like: HER1 (e.g., GenBank Accession Nos. U48722, SEG_HEGFREXS, KO03193), HER2 (Yoshino et al., 1994 *J. Immunol.* 152:2393; Disis et al., 1994 *Canc. Res.* 54:16; see also, e.g., GenBank Acc. Nos. X03363, M17730, SEG_HUMHER20), HER3 (e.g., GenBank Acc. Nos. U29339, M34309), HER4 (Plowman et al., 1993 *Nature* 366:473; see also e.g., GenBank Acc. Nos. L07868, T64105), epidermal growth factor receptor (EGFR) (e.g., GenBank Acc. Nos. U48722, SEG_HEGFREXS, K03193), vascular endothelial cell growth factor (e.g., GenBank No. M32977), vascular endothelial cell growth factor receptor (VEGF) (e.g., GenBank Acc. Nos. AF022375, 1680143, U48801, X62568), insulin-like growth factor-I (e.g., GenBank Acc. Nos. X00173, X56774, X56773, X06043, see also European Patent No. GB 2241703), insulin-like growth factor-II (e.g., GenBank Acc. Nos. X03562, X00910, SEG_HUMGFIA, SEG_HUMGFI2, M17863, M17862), transferrin receptor (Trowbridge and Omary, 1981 *Proc. Nat. Acad. USA* 78:3039; see also e.g., GenBank Acc. Nos. X01060, M11507), estrogen receptor (e.g., GenBank Acc. Nos. M38651, X03635, X99101, U47678, M12674), progesterone receptor (e.g., GenBank Acc. Nos. X51730, X69068, M15716), follicle stimulating hormone receptor (FSH-R) (e.g., GenBank Acc. Nos. Z34260, M65085), retinoic acid receptor (e.g., GenBank Acc. Nos. L12060, M60909, X77664, X57280, X07282, X06538), MUC-1 (Barnes et al., 1989 *Proc. Nat. Acad. Sci. USA* 86:7159; see also e.g., GenBank Acc. Nos. SEG_MUSMUCIO, M65132, M64928) NY-ESO-1 (e.g., GenBank Acc. Nos. AJ003149, U87459), NA 17-A (e.g., European Patent No. WO 96/40039), Melan-A/MART-1 (Kawakami et al., 1994 *Proc. Nat. Acad. Sci. USA* 91:3515; see also e.g., GenBank Acc. Nos. U06654, U06452), tyrosinase (Topalian et al., 1994 *Proc. Nat. Acad. Sci. USA* 91:9461; see also e.g., GenBank Acc. Nos. M26729, SEG_HUMTYR0, see also Weber et al., *J. Clin. Invest* (1998) 102:1258), Gp-100 (Kawakami et al., 1994 *Proc. Nat. Acad. Sci. USA* 91:3515; see also e.g., GenBank Acc. No. S73003, see also European Patent No. EP 668350; Adema et al., 1994 *J. Biol. Chem.* 269:20126), MAGE (van den Bruggen et al., 1991 *Science* 254:1643; see also e.g, GenBank Acc. Nos. U93163, AF064589, U66083, D32077, D32076, D32075, U10694, U10693, U10691, U10690, U10689, U10688, U10687, U10686, U10685, L18877, U10340, U10339, L18920, U03735, M77481), BAGE (e.g., GenBank Acc. No. U19180; see also U.S. Pat. Nos. 5,683,886 and 5,571,711), GAGE (e.g., GenBank Acc. Nos. AF055475, AF055474, AF055473, U19147, U19146, U19145, U19144, U19143, U19142), any of the CTA class of receptors including in particular HOM-MEL-40 antigen encoded by the SSX2 gene (e.g., GenBank Acc. Nos. X86175, U90842, U90841, X86174), carcinoembyonic antigen (CEA, Gold and Freedman, 1985 *J. Exp. Med.* 121:439; see also e.g., GenBank Acc. Nos. SEG_HUMCEA, M59710, M59255, M29540), and PyLT (e.g., GenBank Acc. Nos. J02289, J02038).

Additional cell surface receptors that may be sources of binding region or binding domain polypeptides or portions thereof, or that may be targets, including target antigens, include the following, or the like: CD2 (e.g., GenBank Acc. Nos. Y00023, SEG_HUMCD2, M16336, M16445, SEG_MUSCD2, M14362), 4-1BB (CDw137, Kwon et al., 1989 *Proc. Nat. Acad. Sci. USA* 86:1963, 4-1BB ligand (Goodwin et al., 1993 *Eur. J. Immunol.* 23:2361; Melero et al., 1998 *Eur. J. Immunol.* 3:116), CD5 (e.g., GenBank Acc. Nos. X78985, X89405), CD10 (e.g., GenBank Acc. Nos. M81591, X76732) CD27 (e.g., GenBank Acc. Nos. M63928, L24495, L08096), CD28 (June et al., 1990 *Immunol. Today* 11:211; see also, e.g., GenBank Acc. Nos. J02988, SEG_HUMCD28, M34563), CD152/CTLA-4 (e.g., GenBank Acc. Nos. L15006, X05719, SEG_HUMIGCTL), CD40 (e.g., GenBank Acc. Nos. M83312, SEG_MUSC040A0, Y10507, X67878, X96710, U15637, L07414), interferon-γ (IFN-γ; see, e.g., Farrar et al. 1993 *Ann. Rev. Immunol.* 11:571 and references cited therein, Gray et al. 1982 *Nature* 295:503, Rinderknecht et al. 1984 *J. Biol. Chem.* 259:6790, DeGrado et al. 1982 *Nature* 300:379), interleukin-4 (IL-4; see, e.g., 53$^{rd}$ *Forum in Immunology*, 1993 *Research in Immunol.* 144: 553-643; Banchereau et al., 1994 in *The Cytokine Handbook*, 2$^{nd}$ ed., A. Thomson, ed., Academic Press, NY, p. 99; Keegan et al., 1994 *J. Leukocyt. Biol.* 55:272, and references cited therein), interleukin-17 (IL-17) (e.g., GenBank Acc. Nos. U32659, U43088) and interleukin-17 receptor (IL-17R) (e.g., GenBank Acc. Nos. U31993, U58917). Notwithstanding the foregoing, the present invention expressly does not encompass any immunoglobulin fusion protein that is disclosed in U.S. Pat. No. 5,807,734, or U.S. Pat. No. 5,795,572.

Additional cell surface receptors that may be sources of binding region or binding domain polypeptides or portions thereof, or that may serve as targets including target antigens or binding sites include the following, or the like: CD59 (e.g., GenBank Acc. Nos. SEG_HUMCD590, M95708, M34671), CD48 (e.g., GenBank Acc. Nos. M59904), CD58/LFA-3 (e.g., GenBank Acc. No. A25933, Y00636, E12817; see also JP 1997075090-A), CD72 (e.g., GenBank Acc. Nos. AA311036, 540777, L35772), CD70 (e.g., GenBank Acc. Nos. Y13636, S69339), CD80/B7.1 (Freeman et al., 1989 *J. Immunol.* 43:2714; Freeman et al., 1991 *J. Exp. Med.* 174: 625; see also e.g., GenBank Acc. Nos. U33208, 1683379), CD86/B7.2 (Freeman et al., 1993 *J. Exp. Med.* 178:2185, Boriello et al., 1995 *J. Immunol.* 155:5490; see also, e.g., GenBank Acc. Nos. AF099105, SEG_MMB72G, U39466, U04343, SEG_HSB725, L25606, L25259), B7-H1/B7-DC (e.g., Genbank Acc. Nos. NM_014143, AF177937, AF317088; Dong et al., 2002 *Nat. Med.* June 24 [epub ahead of print], PMID 12091876; Tseng et al., 2001 *J. Exp. Med.* 193:839; Tamura et al., 2001 *Blood* 97:1809; Dong et al., 1999 *Nat. Med.* 5:1365), CD40 ligand (e.g., GenBank Acc. Nos. SEG_HUMCD40L, X67878, X65453, L07414), IL-17 (e.g., GenBank Acc. Nos. U32659, U43088), CD43 (e.g., GenBank Acc. Nos. X52075, J04536), ICOS (e.g., Genbank Acc. No. AH011568), CD3 (e.g., Genbank Acc. Nos. NM_000073 (gamma subunit), NM_000733 (epsilon subunit), X73617 (delta subunit)), CD4 (e.g., Genbank Acc. No. NM_000616), CD25 (e.g., Genbank Acc. No. NM_000417), CD8 (e.g., Genbank Acc. No.M12828), CD11b (e.g., Genbank Acc. No. J03925), CD14 (e.g., Genbank Acc. No. XM_039364), CD56 (e.g., Genbank Acc. No.U63041), CD69 (e.g., Genbank Acc. No.NM_001781) and VLA-4 ($\alpha_4\beta_7$) (e.g., GenBank Acc. Nos. L12002, X16983, L20788, U97031, L24913, M68892, M95632). The following cell surface receptors are typically associated with B cells: CD19 (e.g., GenBank Acc. Nos. SEG_HUMCD19W0, M84371, SEG_MUSCD19W, M62542), CD20 (e.g., GenBank Acc. Nos. SEG_HUMCD20, M62541), CD22 (e.g., GenBank Acc. Nos. 1680629, Y10210, X59350, U62631, X52782, L16928), CD30 (e.g., Genbank Acc. Nos. M83554, D86042), CD153 (CD30 ligand, e.g., GenBank Acc. Nos. L09753, M83554), CD37 (e.g., GenBank Acc. Nos. SEG_MMCD37X, X14046, X53517), CD50 (ICAM-3, e.g., GenBank Acc. No. NM_002162), CD106 (VCAM-1) (e.g., GenBank Acc. Nos. X53051, X67783, SEG_MMVCAM1C, see also U.S. Pat. No. 5,596,090), CD54 (ICAM-1) (e.g., GenBank Acc. Nos. X84737, 582847, X06990, J03132, SEG_MUSICAMO), interleukin-12 (see, e.g., Reiter et al, 1993 *Crit. Rev. Immunol.* 13:1, and references cited therein), CD134 (OX40, e.g., GenBank Acc. No. AJ277151), CD137 (41BB, e.g., GenBank Acc. No. L12964, NM_001561), CD83 (e.g., GenBank Acc. Nos. AF001036, AL021918), DEC-205 (e.g., GenBank Acc. Nos. AF011333, U19271).

Constructs, including binding domain-immunoglobulin fusion proteins, of the present invention comprise, for example, a binding domain, such as a binding domain polypeptide that, according to certain particularly preferred embodiments, is capable of binding or specifically binding at least one target, for example, a target antigen or other binding site that is present on an immune effector cell. According to non-limiting theory, such constructs, including for example binding domain-immunoglobulin fusion proteins, may advantageously recruit desired immune effector cell function(s) in a therapeutic context, where it is well known that immune effector cells having different specialized immune functions can be identified or distinguished from one another on the basis of their differential expression of a wide variety of cell surface antigens, including many of the antigens described herein to which constructs of the invention including binding domain polypeptides can specifically bind. As noted herein, immune effector cells include any cell that is capable of directly mediating an activity that is a component of immune system function, including cells having such capability naturally or as a result of genetic engineering.

In certain embodiments an immune effector cell comprises a cell surface receptor for an immunoglobulin or other peptide binding molecule, such as a receptor for an immunoglobulin constant region and including the class of receptors commonly referred to as "Fc receptors" ("FcR"s). A number of FcRs have been structurally and/or functionally characterized and are well known in the art, including FcR having specific abilities to interact with a restricted subset of immunoglobulin heavy chain isotypes, or that interact with Fc domains with varying affinities, and/or which may be expressed on restricted subsets of immune effector cells under certain conditions (e.g., Kijimoto-Ochichai et al., 2002 *Cell Mol. Life. Sci.* 59:648; Davis et al., 2002 *Curr. Top. Microbiol. Immunol.* 266:85; Pawankar, 2001 *Curr. Opin. Allerg. Clin. Immunol.* 1:3; Radaev et al., 2002 *Mol. Immunol.* 38:1073; Wurzburg et al., 2002 *Mol. Immunol.* 38:1063; Sulica et al., 2001 *Int. Rev. Immunol.* 20:371; Underhill et al., 2002 *Ann. Rev. Immunol.* 20:825; Coggeshall, 2002 *Curr. Dir. Autoimm.* 5:1; Mimura et al., 2001 *Adv. Exp. Med. Biol.* 495:49; Baumann et al., 2001 *Adv. Exp. Med. Biol.* 495:219; Santoso et al., 2001 *Ital. Heart J.* 2:811; Novak et al., 2001 *Curr. Opin. Immunol.* 13:721; Fossati et al., 2001 *Eur. J. Clin. Invest.* 31:821).

Cells that are capable of mediating ADCC are preferred examples of immune effector cells according to the present invention. Other preferred examples include Natural Killer cells, tumor-infiltrating T lymphocytes (TILs), cytotoxic T lymphocytes, and granulocytic cells such as cells that comprise allergic response mechanisms. Immune effector cells thus include, but are not limited to, cells of hematopoietic origins including cells at various stages of differentiation within myeloid and lymphoid lineages and which may (but need not) express one or more types of functional cell surface FcR, such as T lymphocytes, B lymphocytes, NK cells, monocytes, macrophages, dendritic cells, neutrophils, basophils, eosinophils, mast cells, platelets, erythrocytes, and precursors, progenitors (e.g., hematopoietic stem cells), as well as quiescent, activated, and mature forms of such cells. Other immune effector cells may include cells of non-hematopoietic origin that are capable of mediating immune functions, for example, endothelial cells, keratinocytes, fibroblasts, osteoclasts, epithelial cells, and other cells. Immune effector cells may also include cells that mediate cytotoxic or cytostatic events, or endocytic, phagocytic, or pinocytotic events, or that effect induction of apoptosis, or that effect microbial immunity or neutralization of microbial infection, or cells that mediate allergic, inflammatory, hypersensitivity and/or autoimmune reactions.

Allergic response mechanisms are well known in the art and include an antigen (e.g., allergen)-specific component such as an immunoglobulin (e.g., IgE), as well as the cells and mediators which comprise sequelae to allergen-immunoglobulin (e.g., IgE) encounters (e.g., Ott et al., 2000 *J. Allerg. Clin. Immunol.* 106:429; Barnes, 2000 *J. Allerg. Clin. Immunol.* 106:5; Togias, 2000 *J. Allerg. Clin. Immunol.* 105:S599; Akdis et al., 2000 *Int. Arch. Allerg. Immunol.* 121:261; Beach, 2000 *Occup. Med.* 15:455). Particularly with regard to constructs, including binding domain-immunoglobulin fusion proteins, of the present invention that interact with FcR, certain embodiments of the present invention contemplate constructs including fusion proteins that comprise one or more IgE-derived domains including, for example, those that are capable of inducing an allergic response mechanism that comprises IgE-specific FcR, or portions thereof, which IgE-specific FcRs include those noted above and described or identified in the cited articles. Without wishing to be bound by particular theory or mechanism, and as disclosed herein, constructs, including fusion proteins, of the present invention may comprise portions of IgE heavy chain Fc domain polypeptides, for example, native or engineered IgE CH3 and CH4 domains, whether provided or expressed as cell surface proteins (e.g., with a plasma membrane anchor domain) or as soluble or otherwise not cell-bound proteins (e.g., without a plasma membrane anchor domain). Further according to non-limiting theory, recruitment and induction of an allergic response mechanism (e.g., an FcR-epsilon expressing immune effector cell) may proceed as the result of either or both of the presence of an IgE Fc domain or portion thereof as described herein (e.g., one that is capable of triggering an allergic mechanism by FcR crosslinking) and the presence of a target such as a antigen to which the binding region, for example a binding domain, binds or specifically binds. The present invention therefore exploits induction of allergic response mechanisms in heretofore unappreciated contexts, such as treatment of a malignant condition or a B cell disorder, including those described or referenced herein.

An immunoglobulin hinge region polypeptide includes any hinge peptide or polypeptide that occurs naturally, as an artificial peptide or as the result of genetic engineering and that is situated, for example, in an immunoglobulin heavy chain polypeptide between the amino acid residues responsible for forming intrachain immunoglobulin-domain disulfide bonds in CH1 and CH2 regions. Hinge region polypeptides for use in the present invention may also include a mutated or otherwise alterd hinge region polypeptide. Accordingly, for example, an immunoglobulin hinge region polypeptide may be derived from, or may be a portion or fragment of (i.e., one or more amino acids in peptide linkage, typically about 15-115 amino acids, preferably about 95-110, about 80-94, about 60-80, or about 5-65 amino acids, preferably about 10-50, more preferably about 15-35, still more preferably about 18-32, still more preferably about 20-30, still more preferably about 21, 22, 23, 24, 25, 26, 27, 28 or 29 amino acids) an immunoglobulin polypeptide chain region classically regarded as having hinge function, including those described herein, but a hinge region polypeptide for use in the instant invention need not be so restricted and may include one or more amino acids situated (according to structural criteria for assigning a particular residue to a particular domain that may vary, as known in the art) in an adjoining immunoglobulin domain such as a CH1 domain and/or a CH2 domain in the cases of IgG, IgA and IgD (or in an adjoining immunoglobulin domain such as a CH1 domain and/or a CH3 domain in the case of IgE), or in the case of certain artificially engineered immunoglobulin constructs, an immunoglobulin variable region domain.

Wild-type immunoglobulin hinge region polypeptides include any known or later-discovered naturally occurring hinge region that is located between the constant region domains, CH1 and CH2, of an immunoglobulin, for example, a human immunoglobulin (or between the CH1 and CH3 regions of certain types of immunoglobulins, such as IgE). For use in constructing one type of connecting region, the wild-type immunoglobulin hinge region polypeptide is preferably a human immunoglobulin hinge region polypeptide, preferably comprising a hinge region from a human IgG, IgA, or IgD immunoglobulin (or the CH2 region of an IgE immunoglobulin), and more preferably, for example, a hinge region polypeptide from a wild-type or mutated human IgG1 isotype as described herein.

As is known to the art, despite the tremendous overall diversity in immunoglobulin amino acid sequences, immunoglobulin primary structure exhibits a high degree of sequence conservation in particular portions of immunoglobulin polypeptide chains, notably with regard to the occurrence of cysteine residues which, by virtue of their sulfyhydryl groups, offer the potential for disulfide bond formation with other available sulfydryl groups. Accordingly, in the context of the present invention wild-type immunoglobulin hinge region polypeptides for use as connecting regions include those that feature one or more highly conserved (e.g., prevalent in a population in a statistically significant manner) cysteine residues, and in certain preferred embodiments a connecting region may comprise, or consist essentially of, or consist of, a mutated hinge region polypeptide may be selected that contains less than the number of naturally-occurring cysteines, for example, zero or one or two cysteine residue(s) in the case of IgG1 and IgG4 hinge regions, and that is derived or constructed from (or using) such a wild-type hinge region sequence.

In certain preferred embodiments wherein the connecting region is a hinge region polypeptide and the hinge region polypeptide is a mutated, engineered or otherwise altered human IgG1 immunoglobulin hinge region polypeptide that is derived or constructed from (or using) a wild-type hinge region sequence, it is noted that the wild-type human IgG1 hinge region polypeptide sequence comprises three non-adjacent cysteine residues, referred to as a first cysteine of the wild-type hinge region, a second cysteine of the wild-type hinge region and a third cysteine of the wild-type hinge region, respectively, proceeding along the hinge region sequence from the polypeptide N-terminus toward the C-terminus. This can be referred to herein as a "CCC" hinge (or a "WTH", i.e., a wild-type hinge). Examples of mutated or engineered hinge regions include those with no cysteines, which may be referred to herein as an "XXX" hinge (or, for example, as "MH-XXX," referring to a mutant or engineered hinge with three amino acids or other molecules in place of naturally occurring cysteines, such as, for example, "MH-SSS", which refers to a mutant hinge with three serine residues in place of the naturally occurring cysteine residues. It will be understood that the term "mutant" refers only to the fact that a different molecule or molecules is present, or no molecule, at the position of a naturally occurring residue and does not refer to any particular method by which such substitution, alteration, or deletion has been carried out. Accordingly, in certain embodiments of the present invention, the connecting region may be a hinge region polypeptide and the hinge region polypeptide is a mutated human IgG1 immunoglobulin hinge region polypeptide that contains two cysteine residues and in which the first cysteine of the wild-type hinge region has not changed or deleted, for example. This can be referred to as a "MH-CXX" hinge, for example, a "MH-CSC" hinge, in which case the cysteine residue has been replaced with a serine residue. In certain other embodiments of the present invention the mutated human IgG1 immunoglobulin hinge region polypeptide contains no more than one cysteine residue and include, for example, a "MH-CSS" hinge or a "MH-SSC" hinge or a "MH-CSC" hinge, and in certain other embodiments the mutated human IgG1 immunoglobulin hinge region polypeptide contains no cysteine residues such as, for example, a "MH-SSS" hinge.

The constructs, including binding domain-immunoglobulin fusion proteins, of the present invention expressly do not contemplate any fusion protein that is disclosed in U.S. Pat. No. 5,892,019. U.S. Pat. No. 5,892,019 refers to a human IgG1 hinge region in which the first IgG1 hinge region cysteine residue has been changed or deleted, but retains both of the second and third IgG1 hinge region cysteine residues that correspond to the second and third cysteines of the wild-type IgG1 hinge region sequence. The patent states that the first cysteine residue of the wild-type IgG1 hinge region is replaced to prevent interference by the first cysteine residue with proper assembly of the polypeptide described therein into a dimer. The patent requires that the second and third cysteines of the IgG1 hinge region be retained to provide interchain disulfide linkage between two heavy chain constant regions to promote dimer formation so that the molecule contains has effector function such as the ability to mediate ADCC.

By contrast and as described herein, the constructs, including the binding domain-immunogloblin fusion proteins, of the present invention, various of which are capable of ADCC, CDC and/or complement fixation, for example, are not so limited and may comprise, in pertinent part, for example, (i) a wild-type immunoglobulin hinge region polypeptide, such as a wild-type human immunoglobulin hinge region polypeptide, for example, a human IgG1 immunoglobulin hinge region polypeptide, (ii) a mutated or otherwise altered immunoglobulin hinge region polypeptide, such as a mutated or otherwise altered human immunoglobulin hinge region polypeptide, for example, a mutated or otherwise altered human IgG1 immunoglobulin hinge region polypeptide that, for example, is or has been derived or constructed from (or using) a wild-type immunoglobulin hinge region polypeptide or nucleic acid sequence having three or more cysteine residues, wherein the mutated or otherwise altered human IgG1 immunoglobulin hinge region polypeptide contains two cysteine residues and wherein a first cysteine of the wild-type hinge region is not mutated or deleted, (iii) a mutated or otherwise altered immunoglobulin hinge region polypeptide, such as a mutated or otherwise altered human immunoglobulin hinge region polypeptide, for example, a mutated or otherwise altered human IgG1 immunoglobulin hinge region polypeptide that, for example, is or has been derived or constructed from (or using) a wild-type immunoglobulin hinge region polypeptide or nucleic acid sequence having three or more cysteine residues, wherein the mutated or otherwise altered human IgG1 immunoglobulin hinge region polypeptide contains no more than one cysteine residue, or (iv) a mutated or otherwise altered immunoglobulin hinge region polypeptide, such as a mutated or otherwise altered human immunoglobulin hinge region polypeptide, for example, a mutated or otherwise altered human IgG1 immunoglobulin hinge region polypeptide that is or has been derived or constructed from (or using) a wild-type immunoglobulin hinge region polypeptide or nucleic acid sequence having three or more cysteine residues, wherein the mutated or otherwise altered (for example, by amino acid change or deletion) human IgG1 immunoglobulin hinge region polypeptide contains no cysteine residues. The present invention offers unexpected advantages associated with retention by the constructs, including the fusion proteins, described herein of the ability to mediate ADCC and/or CDC and/or complement fixation notwithstanding that the ability to dimerize via IgG1 hinge region interchain disulfide bonds is ablated or compromised by the removal or replacement of one, two or three hinge region cysteine residues, and even in constructs where the first cysteine of an IgG1 hinge region, for example, is not mutated or otherwise altered or deleted.

A connecting region may comprise a mutated or otherwise altered immunoglobulin hinge region polypeptide, which itself may comprise a hinge region that has its origin in an immunoglobulin of a species, of an immunoglobulin isotype or class, or of an immunoglobulin subclass that is different from that of the tail region, for example, a tail region comprising, or consisting essentially or, or consisting of, CH2 and CH3 domains (or IgE CH3 and CH4 domains). For instance, in certain embodiments of the invention, a construct, for example, a binding domain-immunoglobulin fusion protein, may comprise a binding region such as a binding domain polypeptide that is fused or otherwise connected to an immunoglobulin hinge region polypeptide comprising, or consisting essentially of, or consisting of, a wild-type human IgA hinge region polypeptide, or a mutated or otherwise altered human IgA hinge region polypeptide that contains zero or only one or more cysteine residues (but less than the wild-type number of cysteines), as described herein, or a wild-type human IgG hinge, such as an IgG1 hinge, region polypeptide, or a wild-type human IgE hinge-acting region, i.e., IgE CH2 region polypeptide, or a mutated or otherwise altered human IgG hinge, such as an IgG1 hinge, region polypeptide that is or has been mutated or otherwise altered to contain zero, one or two cysteine residues wherein the first cysteine of the wild-type hinge region is not mutated or altered or deleted, as also described herein. Such a hinge region polypeptide may be fused or otherwise connected to, for example, a tail region comprising, or consisting essentially of, or consisting of, an immunoglobulin heavy chain CH2 region polypeptide from a different Ig isotype or class, for example an IgA or an IgD or an IgG subclass (or a CH3 region from an IgE subclass), which in certain preferred embodiments will be the IgG1 or IgA or IgE subclass and in certain other preferred embodiments may be any one of the IgG2, IgG3 or IgG4 subclasses.

For example, and as described in greater detail herein, in certain embodiments of the present invention a connecting region may be selected to be an immunoglobulin hinge region polypeptide, which is or has been derived from a wild-type human IgA hinge region that naturally comprises three cysteines, where the selected hinge region polypeptide is truncated or otherwise altered or substituted relative to the complete and/or naturally-occurring hinge region such that only one or two of the cysteine residues remain (e.g., SEQ ID NOS:35-36). Similarly, in certain other embodiments of the invention, the construct may be binding domain-immunoglobulin fusion protein comprising a binding domain polypeptide that is fused or otherwise connected to an immunoglobulin hinge region polypeptide comprising a mutated or otherwise altered hinge region polypeptide in which the number of cysteine residues is reduced by amino acid substitution or deletion, for example a mutated or otherwise altered IgG1 hinge region containing zero, one or two cysteine residues as described herein, or an IgD hinge region containing zero cysteine residues.

A mutated or otherwise altered hinge region polypeptide may thus be derived or constructed from (or using) a wild-type immunoglobulin hinge region that contains one or more cysteine residues. In certain embodiments, a mutated or otherwise altered hinge region polypeptide may contain zero or only one cysteine residue, wherein the mutated or otherwise altered hinge region polypeptide is or has been derived from a wild type immunoglobulin hinge region that contains, respectively, one or more or two or more cysteine residues. In the mutated or otherwise altered hinge region polypeptide, the cysteine residues of the wild-type immunoglobulin hinge region are preferably deleted or substituted with amino acids that are incapable of forming a disulfide bond. In one embodiment of the invention, a mutated or otherwise altered hinge region polypeptide is or has been derived from a human IgG wild-type hinge region polypeptide, which may include any of the four human IgG isotype subclasses, IgG1, IgG2, IgG3 or IgG4. In certain preferred embodiments, the mutated or otherwise altered hinge region polypeptide is or has been derived from (or using) a human IgA or IgD wild-type hinge region polypeptide. By way of example, a mutated or otherwise altered hinge region polypeptide that is or has been derived from a human IgG1 or IgA wild-type hinge region polypeptide may comprise mutations, alterations, or deletions at two of the three cysteine residues in the wild-type immunoglobulin hinge region, or mutations, alterations, or deletions at all three cysteine residues.

The cysteine residues that are present in a wild-type immunoglobulin hinge region and that are removed or altered by mutagenesis or any other techniques according to particularly preferred embodiments of the present invention include cysteine residues that form, or that are capable of forming, interchain disulfide bonds. Without wishing to be bound by particular theory or mechanism of action, the present invention contemplates that mutation, deletion, or other alteration of such hinge region cysteine residues, which are believed to be involved in formation of interchain disulfide bridges, reduces the ability of the subject invention binding domain-immunoglobulin fusion protein to dimerize (or form higher oligomers) via interchain disulfide bond formation, while surprisingly not ablating or undesireably compromising the ability of a fusion protein or other construct to promote ADCC, and/or CDC and/or to fix complement. In particular, the Fc receptors that mediate ADCC (e.g., FcRIII, CD16) exhibit low affinity for immunoglobulin Fc domains, supporting the idea that functional binding of Fc to FcR requires avidity stabilization of the Fc-FcR complex by virtue of the dimeric structure of heavy chains in a conventional antibody, and/or FcR aggregation and cross-linking by a conventional antibody Fc structure. Sonderman et al., 2000 *Nature* 406:267; Radaev et al., 2001 *J. Biol. Chem.* 276:16469; Radaev et al., 2001 *J. Biol. Chem.* 276:16478; Koolwijk et al., 1989 *J. Immunol.* 143:1656; Kato et al., 2000 *Immunol. Today* 21:310. Hence, the constructs, including for example binding domain-immunoglobulin fusion proteins, of the present invention provide the advantages associated with single-chain constructs including singe-chain immunoglobulin fusion proteins while also unexpectedly retaining one or more immunological activities. Similarly, the ability to fix complement is typically associated with immunoglobulins that are dimeric with respect to heavy chain constant regions such as those that comprise Fc, while various constructs, including binding domain-immunoglobulin fusion proteins, of the present invention, which may, due to the replacement or deletion of hinge region cysteine residues or due to other structural modifications as described herein, for example, have compromised or ablated abilities to form interchain disulfide bonds, exhibit the unexpected ability to fix complement. Additionally, according to certain embodiments of the present invention wherein a construct, including, for example, a binding domain-immunoglobulin fusion protein, may comprise a connecting region and tail region comprising, or consisting essentially of, or consisting of, one or more of a human IgE hinge-acting region, i.e., a IgE CH2 region polypeptide, a human IgE CH3 constant region polypeptide, and a human IgE CH4 constant region polypeptide, the invention constructs including fusion proteins unexpectedly retain the immunological activity of mediating ADCC and/or of inducing an allergic response mechanism.

Selection of an immunoglobulin hinge region polypeptide as a connecting region according to certain embodiments of the subject invention constructs, such as binding domain-immunoglobulin fusion proteins, may relate to the use of an "alternative hinge region" polypeptide sequence, which includes a polypeptide sequence that is not necessarily derived from any immunoglobulin hinge region sequence per se. Instead, an alternative hinge region refers to a hinge region polypeptide that comprises an amino acid sequence, or other molecular sequence, of at least about ten consecutive amino acids or molecules, and in certain embodiments at least about 11, 12, 13, 14, 15, 16, 17, 18, 19, 20, 21-25, 26-30, 31-50, 51-60, 71-80, 81-90, or 91-110 amino acids or molecules that is present in a sequence disclosed herein, for example a polypeptide sequence that is or has been derived from a region located between intrachain disulfide-generated immunoglobulin-like loop domains of immunoglobulin gene superfamily members such as CD2 (e.g., Genbank Acc. No. NM_001767), CD4 (e.g., Genbank Acc. No. NM_000616), CD5 (e.g., Genbank Acc. No. BCO27901), CD6 (e.g., Genbank Acc. No. NM_006725), CD7 (e.g., Genbank Acc. Nos. XM_046782, BC009293, NM_006137) or CD8 (e.g., Genbank Acc. No. M12828), or other Ig superfamily members. By way of non-limiting example, an alternative hinge region used as a connecting region, for example, may provide a glycosylation site as provided herein, or may provide a human gene-derived polypeptide sequence for purposes of enhancing the degree of "humanization" of a fusion protein, or may comprise, or consist essentially of, or consist of, an amino acid sequence that eliminates or reduces the ability of a construct of the invention, such as a fusion protein, to form multimers or oligomers or aggregates or the like. Certain alternative hinge region polypeptide sequences, including those described herein, may be derived or constructed from (or using) the polypeptide sequences of immunoglobulin gene superfamily members that are not actual immunoglobulins per se. For instance and according to non-limiting theory, certain polypeptide sequences that are situated between intrachain disulfide-generated immunoglobulin loop domain of immunoglobulin gene super-family member proteins may be used in whole or in part as alternative hinge region polypeptides as provided herein, or may be further modified for such use.

As noted above, the constructs of the invention, including binding domain-immunoglobulin fusion proteins, are believed, according to non-limiting theory, to be compromised in their ability to dimerize via interchain disulfide bond formation, and further according to theory, this property is a consequence, in whole or in part, of a reduction in the number of cysteine residues that are present in an immunoglobulin hinge region polypeptide selected for inclusion in the construction of the construct, such as a fusion protein construct. Determination of the relative ability of a polypeptide to dimerize is well within the knowledge of the relevant art, where any of a number of established methodologies may be applied to detect protein dimerization (see, e.g., Scopes, *Protein Purification: Principles and Practice,* 1987 Springer-Verlag, New York). For example, biochemical separation techniques for resolving proteins on the basis of molecular size (e.g., gel electrophoresis, gel filtration chromatography, analytical ultracentrifugation, etc.), and/or comparison of protein physicochemical properties before and after introduction of sulfhydryl-active (e.g., iodoacetamide, N-ethylmaleimide) or disulfide-reducing (e.g., 2-mercaptoethanol, dithiothreitol) agents, or other equivalent methodologies, may all be employed for determining a degree of polypeptide dimerization or oligomerization, and for determining possible contribution of disulfide bonds to such potential quarternary structure. In certain embodiments, the invention relates to a construct, for example a binding domain-immunoglobulin fusion protein, that exhibits a reduced (i.e., in a statistically significant manner relative to an appropriate IgG-derived control, for example) ability to dimerize, relative to a wild-type human immunoglobulin G hinge region polypeptide as provided herein. Those familiar with the art will be able readily to determine whether a particular fusion protein displays such reduced ability to dimerize.

Compositions and methods for preparation of immunoglobulin fusion proteins, for example, are well known in the art. See, e.g., U.S. Pat. No. 5,892,019, which reports recombinant proteins that are the product of a single encoding polynucleotide but which are not constructs, including binding domain-immunoglobulin fusion proteins, according to the present invention.

Figure 11:
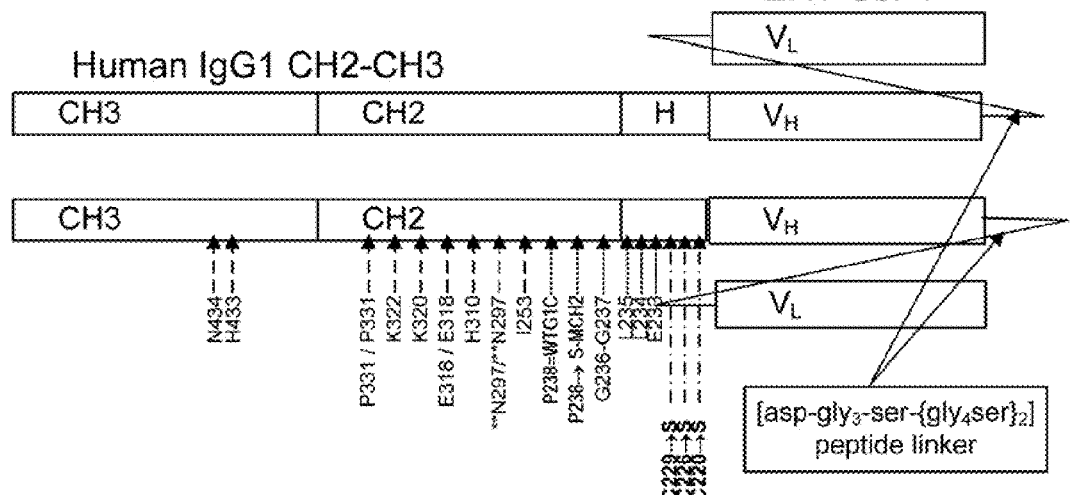
FIG. 11 depicts schematic representations of the structures of 2H7ScFv-Ig fusion proteins referred to as CytoxB or CytoxB derivatives: CytoxB-MHWTG1C (2H7 ScFv, mutant hinge, wild-type human IgG1 Fc domain), CytoxB-MHMG1C (2H7 ScFv, mutant hinge, mutated human IgG1 Fc domain) and CytoxB-IgAHWTHG1C (2H7 ScFv, human IgA-derived hinge [SEQ ID NO:41], wild-type human IgG1 Fc domain). Arrows indicate position numbers of amino acid residues believed to contribute to FcR binding and ADCC activity (heavy arrows), and to complement fixation (light arrows). Note absence of interchain disulfide bonds. Also shown are a peptide linker (SEQ ID NO:682) and a portion of the human IgA hinge (SEQ ID NO:683).

For a construct, for example, in an immunoglobulin fusion protein of the invention that is intended for use in humans, any included Ig constant regions will typically be of human sequence origin, or humanized, to minimize a potential anti-human immune response and to provide appropriate and/or desired effector functions. Manipulation of sequences encoding antibody constant regions is referenced in the PCT publication of Morrison and Oi, WO 89/07142. In particularly preferred embodiments, a tail region is prepared from an immunoglobulin heavy chain constant region in which the CH1 domain is or has been deleted (the CH1 and CH2 regions in the case of IgE) and the carboxyl end of the binding domain, or where the binding domain comprises two immunoglobulin variable region polypeptides, the second (i.e., more proximal to the C-terminus) variable region is joined to the amino terminus of CH2 through one or more connecting regions, such as a hinge or altered region. A schematic diagram depicting the structures of two exemplary binding domain-immunoglobulin fusion proteins is shown in FIG. 11. In particularly preferred embodiments no interchain disulfide bonds are present, and in other embodiments a restricted number of interchain disulfide bonds may be present relative to the number of such bonds that would be present if wild-type hinge region polypeptides were instead present. In other embodiments a construct of the invention, such as for example, a fusion protein, comprises, or consists essentially of, or consists of, a mutated or otherwise altered hinge region polypeptide that exhibits a reduced ability to dimerize, relative to a wild-type human IgG hinge region polypeptide. Thus, an isolated polynucleotide molecule coding for such a single chain construct, such as an immunoglobulin fusion protein, has a binding region, for example, a domain that provides specific or otherwise desired binding affinity and selectivity for a target, such as a target antigen.

The invention also contemplates, for example, in certain embodiments, constructs including binding domain-immunoglobulin fusion proteins that comprise fused or otherwise connected polypeptide sequences or portions thereof derived or prepared from a plurality of genetic sources, for example, according to molecular "domain swapping" paradigms. Those having familiarity with the art will appreciate that selection of such polypeptide sequences for assembly into a construct, such as a binding domain-immunoglobulin fusion protein, for example, may involve determination of appropriate portions of each component polypeptide sequence, for example, based on structural and/or functional properties of each such sequence (see, e.g., Carayannopoulos et al., 1996 *J. Exp. Med.* 183:1579; Harlow et al., Eds., *Antibodies: A Laboratory Manual,* Cold Spring Harbor Laboratory, Cold Spring Harbor (1988)). The component polypeptide sequences of which the construct, such as a fusion protein, is comprised or prepared may therefore comprise intact or full-length binding domain, immunoglobulin, linker and/or plasma membrane anchor domain polypeptide sequences, or truncated versions or variants thereof such as those provided herein. According to these and related embodiments of the invention, any two or more of the candidate component polypeptides of which the subject invention constructs, for example, fusion proteins, may be comprised will be derived or prepared from independent sources, such as from immunoglobulin sequences of differing allotype, isotype, subclass, class, or species of origin (e.g., xenotype). Thus, as a non-limiting example, a binding domain polypeptide (or its constituent polypeptides such as one or more variable region polypeptides and/or a linker polypeptide), a hinge region polypeptide, immunoglobulin heavy chain CH2 and CH3 constant region polypeptides and optionally an immunoglobulin heavy chain CH4 constant region polypeptide as may be obtained from an IgM or IgE heavy chain, and a plasma membrane anchor domain polypeptide may all be separately obtained from distinct genetic sources and engineered into a chimeric or fusion protein using well known techniques and according to methodologies described herein, for example.

Accordingly, a construct of the invention, for example a binding domain-immunoglobulin fusion protein according to certain embodiments of the present invention, may also therefore comprise in pertinent part an immunoglobulin heavy chain CH3 constant region polypeptide that is a wild-type IgA CH3 constant region polypeptide, or alternatively, that is a mutated or otherwise altered or substituted or truncated IgA CH3 constant region polypeptide that is incapable of associating with a J chain, or that will not associate to an undesired degree with a J chain; preferably the IgA CH3 constant region polypeptides used in a tail region portion of a construct are of human origin or are humanized. By way of brief background, IgA molecules are known to be released into secretory fluids by a mechanism that involves association of IgA into disulfide-linked polymers (e.g., dimers) via a J chain polypeptide (e.g., Genbank Acc. Nos. XM_059628, M12378, M12759; Johansen et al., 1999 *Eur. J. Immunol.* 29:1701) and interaction of the complex so formed with another protein that acts as a receptor for polymeric immunoglobulin, and which is known as transmembrane secretory component (SC; Johansen et al., 2000 Sc. *J. Immunol.* 52:240; see also, e.g., Sorensen et al., 2000 *Int. Immunol.* 12:19; Yoo et al., 1999 *J. Biol. Chem.* 274:33771; Yoo et al., 2002 *J. Immunol. Meth.* 261:1; Corthesy, 2002 *Trends Biotechnol.* 20:65; Symersky et al., 2000 *Mol. Immunol.* 37:133; Crottet et al., 1999 *Biochem. J.* 341:299). Interchain disulfide bond formation between IgA Fc domains and J chain is mediated through a penultimate cysteine residue in an 18-amino acid C-terminal extension that forms part of the IgA heavy chain constant region CH3 domain polypeptide (Yoo et al., 1999; Sorensen et al., 2000). Certain embodiments of the subject invention constructs, including for example, fusion proteins, therefore contemplate inclusion of the wild-type IgA heavy chain constant region polypeptide sequence, which is capable of associating with J chain. Certain other embodiments of the invention, however, contemplate fusion proteins that comprise a mutated or otherwise altered, substituted, or truncated IgA CH3 constant region polypeptide that is incapable of associating with a J chain. According to such embodiments, for example, two or more residues from the C-terminus of an IgA CH3 constant region polypeptide such as a human IgA CH3 constant region polypeptide may be deleted to yield a truncated CH3 constant region polypeptide as provided herein. In preferred embodiments and as described in greater detail herein, a mutated human IgA CH3 constant region polypeptide that is incapable of associating with a J chain comprises such a C-terminal deletion of either four or 18 amino acids. However, the invention need not be so limited, such that the mutated IgA CH3 constant region polypeptide may comprise a deletion of about 2, 3, 4, 5, 6, 7, 8, 9, 10, 11, 12, 13, 14, 15, 16, 17, 18, 19, 20, 21-25, 26-30 or more amino acids, so long as the construct, for example, the fusion protein, is capable of specifically binding an antigen and of at least one immunological activity as provided herein. Alternatively, the invention also contemplates constructs, for example, fusion proteins, having a tail region that comprises a mutated IgA CH3 constant region polypeptide that is incapable of associating with a J chain by virtue of replacement of the penultimate cysteine, or by chemical modification of that amino acid residue, in a manner that prevents, or inhibits an undesired level of, interchain disulfide bond or multimer formation. Methods for determining whether a construct, for example a fusion protein, can associate with a J chain will be known to those having familiarity with the art and are described or referenced herein.

As also described herein and according to procedures known in the art, the construct, for example a fusion protein, may further be tested routinely for immunological activity, for instance, in ADCC or CDC assays. As an illustrative example, a construct, for example a fusion protein, according to such an embodiment may comprise a binding domain polypeptide derived or constructed from (or using) a native or engineered human heavy chain variable region polypeptide sequence, a native or engineered human IgA-derived immunoglobulin hinge region polypeptide sequence, a native or engineered human IgG1 immunoglobulin heavy chain CH2 constant region polypeptide sequence, a native or engineered human IgG2 immunoglobulin heavy chain CH3 constant region polypeptide sequence, and optionally a native or engineered human IgE immunoglobulin heavy chain CH4 constant region polypeptide sequence and/or a native or engineered human TNF-α receptor type 1 (TNFR1) plasma membrane anchor domain polypeptide sequence that comprises a cytoplasmic tail polypeptide which is capable of apoptotic signaling or otherwise promoting apoptosis. The invention therefore contemplates these and other embodiments according to the present invention in which two or more polypeptide sequences that are present in a construct, for example a fusion protein, have independent genetic origins.

As noted above, in certain embodiments the construct, for example a binding protein-immunoglobulin fusion protein, comprises at least one native or engineered immunoglobulin variable region polypeptide, which may be a native or engineered light chain or a native or engineered heavy chain variable region polypeptide, and in certain embodiments the fusion protein comprises at least one such native or engineered light chain V-region and one such native or engineered heavy chain V-region and at least one linker peptide that is fused or otherwise connected to to each of the native or engineered V-regions. Construction of such binding domains, for example single chain Fv domains, is known in the art and is described in greater detail in the Examples below, and has been described, for example, in various documents cited herein; selection and assembly of single-chain variable regions and of linker polypeptides that may be fused or otherwise connected to each of a heavy chain-derived and a light chain-derived V region (e.g., to generate a binding region, such as a binding domain that comprises a single-chain Fv polypeptide) is also known to the art and described herein. See, e.g., U.S. Pat. Nos. 5,869,620, 4,704,692, and 4,946,778. In certain embodiments all or a portion or portions of an immunoglobulin sequence that is derived from a non-human source may be "humanized" according to recognized procedures for generating humanized antibodies, i.e., immunoglobulin sequences into which human Ig sequences are introduced to reduce the degree to which a human immune system would perceive such proteins as foreign (see, e.g., U.S. Pat. Nos. 5,693,762; 5,585,089; 4,816,567; 5,225,539; 5,530,101; and documents cited therein).

Constructs of the invention, including binding domain-immunoglobulin fusion proteins, as described herein may, according to certain embodiments, desirably comprise sites for glycosylation, e.g., covalent attachment of carbohydrate moieties such as, for example, monosaccharides or oligosaccharides. Incorporation of amino acid sequences that provide substrates for polypeptide glycosylation is within the scope of the relevant art, including, for example, the use of genetic engineering or protein engineering methodologies to obtain a polypeptide sequence containing, for example, the classic Asn-X-Ser/Thr site for N-(asparagine)-linked glycosylation, or a sequence containing Ser or Thr residues that are suitable substrates for O-linked glycosylation, or sequences amenable to C-mannosylation, glypiation/glycosylphosphatidylinositol modification, or phosphoglycation, all of which can be identified according to art-established criteria (e.g., Spiro, 2002 *Glybiology* 12:43R). Without wishing to be bound by any particular theory or mechanism, glycosylated constructs such as fusion proteins having particular amino acid sequences may beneficially possess attributes associated with one or more of improved solubility, enhanced stability in solution, enhanced physiological stability, improved bioavailability including in vivo biodistribution, and superior resistance to proteases, all in a statistically significant manner, relative to constructs, including fusion proteins, having the same or highly similar amino acid sequences but lacking glycosyl moieties. In certain preferred embodiments the subject invention constructs, such as fusion protein constructs, may comprise a glycosylation site that is present in a linker as provided herein, and in certain other preferred embodiments the subject invention construct, for example, a fusion protein, comprises a glycosylation site that is present in a connecting region, such as a hinge region polypeptide sequence as provided herein.

In certain preferred embodiments of the present invention, such as those useful for gene therapy applications or in display systems or assays, such as screening assays (including library display systems and library screening assays), the construct, for example, a binding domain-immunoglobulin fusion protein, is a protein or glycoprotein that is capable of being expressed by a host cell such that it localizes to the cell surface. Constructs, such as binding domain-immunoglobulin fusion proteins, that localize to the cell surface may do so by virtue of having naturally present or artificially introduced structural features that direct the fusion protein to the cell surface (e.g., Nelson et al. 2001 *Trends Cell Biol.* 11:483; Ammon et al., 2002 *Arch. Physiol. Biochem.* 110:137; Kasai et al., 2001 *J. Cell Sci.* 114:3115; Watson et al., 2001 *Am. J. Physiol. Cell Physiol.* 281:C215; Chatterjee et al., 200 *J. Biol. Chem.* 275:24013) including by way of illustration and not limitation, secretory signal sequences, leader sequences, plasma membrane anchor domain polypeptides and transmembrane domains such as hydrophobic transmembrane domains (e.g., Heuck et al., 2002 *Cell Biochem. Biophys.* 36:89; Sadlish et al., 2002 *Biochem J.* 364:777; Phoenix et al., 2002 *Mol. Membr. Biol.* 19:1; Minke et al., 2002 *Physiol. Rev.* 82:429) or glycosylphosphatidylinositol attachment sites ("glypiation" sites, e.g., Chatterjee et al., 2001 *Cell Mol. Life. Sci.* 58:1969; Hooper, 2001 *Proteomics* 1:748; Spiro, 2002 *Glycobiol.* 12:43R), cell surface receptor binding domains, extracellular matrix binding domains, or any other structural feature that causes at least a desired portion of the fusion protein population to localize, in whole or in part, to the cell surface. Particularly preferred are fusion protein constructs that comprise a plasma membrane anchor domain which includes a transmembrane polypeptide domain, typically comprising a membrane spanning domain which includes a hydrophobic region capable of energetically favorable interaction with the phospholipid fatty acyl tails that form the interior of the plasma membrane bilayer. Such features are known to those of ordinary skill in the art, who will further be familiar with methods for introducing nucleic acid sequences encoding these features into the subject expression constructs by genetic engineering, and with routine testing of such constructs to verify cell surface localization of the product.

According to certain further embodiments, a plasma membrane anchor domain polypeptide comprises such a transmembrane domain polypeptide and also comprises a cytoplasmic tail polypeptide, which refers to a region or portion of the polypeptide sequence that contacts the cytoplasmic face of the plasma membrane and/or is in contact with the cytosol or other cytoplasmic components. A large number of cytoplasmic tail polypeptides are known that comprise the intracellular portions of plasma membrane transmembrane proteins, and discrete functions have been identified for many such polypeptides, including biological signal transduction (e.g., activation or inhibition of protein kinases, protein phosphatases, G-proteins, cyclic nucleotides and other second messengers, ion channels, secretory pathways), biologically active mediator release, stable or dynamic association with one or more cytoskeletal components, cellular differentiation, cellular activation, mitogenesis, cytostasis, apoptosis and the like (e.g., Maher et al., 2002 *Immunol. Cell Biol.* 80:131; El Far et al., 2002 *Biochem J.* 365:329; Teng et al., 2002 *Genome Biol.* 2REVIEWS:3012; Simons et al., 2001 *Cell Signal* 13:855; Furie et al., 2001 *Thromb. Haemost.* 86:214; Gaffen, 2001 *Cytokine* 14:63; Dittel, 2000 *Arch. Immunol. Ther. Exp.* (Warsz.) 48:381; Parnes et al., 2000 *Immunol. Rev.* 176:75; Moretta et al., 2000 *Semin. Immunol.* 12:129; Ben Ze'ev, 1999 *Ann. N.Y. Acad. Sci.* 886:37; Marsters et al., *Recent Prog. Horm. Res.* 54:225).

FIG. 70 illustrates the binding, for example, of fluorceine-conjugated FcRIII (CD16) soluble fusion proteins to 2H7 scFv-binding domain constructs that are attached to CD20 expressed by cells, CHO cells in this example. CD16 binding to a construct of the invention, for example, scFv-binding domain construct, provides one example of a screening tool that may be used to detect and/or quantitate changes in CD16 binding to altered constructs of the invention, including scFv-binding domain constructs, that contains targeted or site-specific mutations, substitutions, deletions, or other alterations. Changes in CD16 binding properties may be reflected, for example, by changes in binding of either CD16 high affinity protein (158V) or CD16 low affinity protein (158 F) or both.

A schematic representation of one example of such a screening process is diagrammed in the second drawing in FIG. 70, in which scFv-binding domain constructs are displayed on the cell surface of mammalian cells. scFv-binding domain molecules in this example are displayed on the cell surface through a molecule that serves as a transmembrane domain anchor. These molecules may represent, for example, a single scFv-binding domain construct or may be introduced into a population of mammalian cells as a library of such molecules. Transfected cells with altered binding properties can then, for example, be panned, sorted, or otherwise isolated from other cells by altering the stringency of the selection conditions and using CD16 fusion proteins as a binding probe. Cells that express scFv-Ig molecules with altered binding to either CD16 high affinity allele (158V) or CD16 low affinity allele (158F) or both, for example, can be isolated.

This display system can be used, for example, to create a library of constructs of the invention with mutated or otherwise altered tail regions with short stretches of CH2 sequence replaced with randomized oligonucleotides or, for example, randomization of a single residue with all possible amino acid substitutions, natural or unnatural, including synthetic amino acids. Once such a library is constructed, it can be transfected into appropriate cells, for example, COS cells, by methods known in the art. Transfectants can then be bound to, for example, labeled CD16 constructs, and panned or sorted based on their relative or desired binding properties to multiple allelotypes/isoforms. Desired cells may be harvested, and the DNA, for example, plasmid DNA, isolated and then transformed into, for example, bacteria. This process may be repeated iteratively multiple times until desire single clones are isolated from the mammalian host cells. See Seed B and Aruffo A, *Pro. Nat'l Acad Sci USA* 1987 84:3365-3369; Aruffo A and Seed B, *Pro. Nat'l Acad Sci USA* 1987 84:8573-8577.

One such use of this type of screening system, for example, is for the identification and/or isolation of constructs of the invention having tail regions, or tail regions, that bind equally well to both the high and low affinity alleles of CD16 with the goal of improving effector functions mediated by scFv-binding domain constructs in multiple subpopulations of patients. Constructs of the invention having tail regions, or tail regions with altered binding properties to other Fc receptors can also be selected using such a display system, for example, the display system described. Other display systems that do not glycosylate proteins, for example, those that use bacteriophage or yeast, are not generally desired for selection of constructs of the invention having Ig-based tail regions, or Ig-based tail regions, with altered FcR binding properties. Most non-mammalian systems, for example, do not glycosylate proteins.

Expression of constructs of the invention, for example, scFv-binding domain constructs, expressd on the surface of a mammalian cell by incorporation of an appropriate molecule into the construct, for example, by incorporation of a transmembrane domain or a GPI anchor signal, also have utility in other display systems that are useful, for example, for selection of constructs of the invention, for example, altered scFv-binding domain molecules that will be produced at higher or other desired levels. In one such an embodiment, cells that are useful in the production of glycosylated proteins, for example, mammalian cells such as COS cells, are transfected with a library of scFv-binding domain constructs in a plasmid that directs their expression to the cell surface. Cells, such as COS cells, that express the highest or other desired level of the scFv-binding domain molecules are selected by techniques known in the art (for example panning, sterile cell sorting, magnetic bead separation, etc.), and DNA, for example, plasmid DNA, is isolated for transformation into other cells, for example, bacteria. After one or more rounds of selection single clones are isolated that encode scFv-binding domain molecules capable of a high or other desired level of expression. The isolated clones may then be altered to remove the membrane anchor and expressed in an appropriate cells system, for example, a mammalian cell system, wherein the scFv-binding domain constructs will be produced, for example, by secretion into the culture fluid at desired levels. Without being bound by any particular mechanism or theory, this is believed to result from the common requirement of secreted glycoproteins and cell surface glycoproteins for a signal peptide and processing through the golgi for expression. Thus, selection for a molecule that shows an improvement expression levels on a cell surface will also result in the identification of a molecule having an improvement in levels of secreted protein.

These display systems utilizing a construct of the invention may also be used for screening and/or identifying and/or isolating affinity variants of the binding domain within a construct.

Particularly preferred are such display and/or screening systems, for example, that include or use constructs that include (1) an immunoglobulin variable region polypeptide sequence, including native or engineered $V_H$ and/or $V_L$ and/or single-chain variable region (sFv) sequences, and which include, for example, a mutation, alteration or deletion at an amino acid at a location or locations corresponding to one or more of amino acid positions 9, 10, 11, 12, 108, 110, 111, and 112, in a $V_H$ region sequence (including in a $V_H$ region sequence within an scFv or other construct), and/or (2) an immunoglobulin variable region polypeptide sequence, including native or engineered $V_H$ and/or $V_L$ and/or single-chain variable region (sFv) sequences, and which include, for example, a mutation, alteration or deletion at a location or locations corresponding to one or more of amino acid positions 12, 80, 81, 82, 83, 105, 106, 107 and 108 in a light chain variable region sequence (including in a $V_L$ region sequence within an scFv or other construct). Especially preferred are such display and/or screening systems that include or use constructs that include an engineered $V_H$ sequence (whether or not associated with one or more other sequences, including immunoglobulin-derived and other sequences contained, for example, within an sFv or scFv-containing construct), which includes a mutation, alteration or deletion at an amino acid at a location or locations corresponding to amino acid position 11. The $V_H$11 amino acid, if substituted, may be substituted with another amino acid as described herein, or by another molecule as desired.

In the context of other methods of using constructs of the invention, including binding domain-immunoglobulin fusion proteins, for the treatment of a malignant condition or a B cell disorder(s) as provided herein, including, for example, by one or more of a number of gene therapy methods and related construct delivery techniques, the present invention also contemplates certain embodiments wherein a construct, for example, a binding domain-immunoglobulin fusion protein that comprises a plasma membrane anchor domain polypeptide is expressed (or capable or expression) at a cell surface and may further comprise a cytoplasmic tail polypeptide which comprises an apoptosis signaling polypeptide sequence. A number of apoptosis signaling polypeptide sequences are known to the art, as reviewed, for example, in *When Cells Die: A Comprehensive Evaluation of Apoptosis and Programmed Cell Death* (R. A. Lockshin et al., Eds., 1998 John Wiley & Sons, New York; see also, e.g., Green et al., 1998 *Science* 281:1309 and references cited therein; Ferreira et al., 2002 *Clin. Canc. Res.* 8:2024; Gurumurthy et al., 2001 *Cancer Metastas. Rev.* 20:225; Kanduc et al., 2002 *Int. J. Oncol.* 21:165). Typically an apoptosis signaling polypeptide sequence comprises all or a portion of, or is derived or constructed from, a receptor death domain polypeptide, for instance, FADD (e.g., Genbank Acc. Nos. U24231, U43184, AF009616, AF009617, NM_012115), TRADD (e.g., Genbank Acc. No. NM_003789), RAIDD (e.g., Genbank Acc. No. U87229), CD95 (FAS/Apo-1; e.g., Genbank Acc. Nos. X89101, NM_003824, AF344850, AF344856), TNF-α-receptor-1 (TNFR1, e.g., Genbank Acc. Nos. 563368, AF040257), DR5 (e.g., Genbank Acc. No. AF020501, AF016268, AF012535), an ITIM domain (e.g., Genbank Acc. Nos. AF081675, BC015731, NM_006840, NM_006844, NM_006847, XM_017977; see, e.g., Billadeau et al., 2002 *J. Clin. Invest.* 109:161), an ITAM domain (e.g., Genbank Acc. Nos. NM_005843, NM_003473, BC030586; see, e.g., Billadeau et al., 2002), or other apoptosis-associated receptor death domain polypeptides known to the art, for example, TNFR2 (e.g., Genbank Acc. No. L49431, L49432), caspase/procaspase-3 (e.g., Genbank Acc. No. XM_54686), caspase/ procaspase-8 (e.g., AF380342, NM_004208, NM_001228, NM_033355, NM_033356, NM_033357, NM_033358), caspase/procaspase-2 (e.g., Genbank Acc. No. AF314174, AF314175), etc.

Cells in biological samples that are suspected of undergoing apoptosis may be examined for morphological, permeability or other changes that are indicative of an apoptotic state. For example by way of illustration and not limitation, apoptosis in many cell types may cause altered morphological appearance such as plasma membrane blebbing, cell shape change, loss of substrate adhesion properties or other morphological changes that can be readily detected by a person having ordinary skill in the art, for example by using light microscopy. As another example, cells undergoing apoptosis may exhibit fragmentation and disintegration of chromosomes, which may be apparent by microscopy and/or through the use of DNA-specific or chromatin-specific dyes that are known in the art, including fluorescent dyes. Such cells may also exhibit altered plasma membrane permeability properties as may be readily detected through the use of vital dyes (e.g., propidium iodide, trypan blue) or by the detection of lactate dehydrogenase leakage into the extracellular milieu. These and other means for detecting apoptotic cells by morphologic criteria, altered plasma membrane permeability, and related changes will be apparent to those familiar with the art.

In another embodiment of the invention wherein a construct, such as a binding domain-immunoglobulin fusion protein, that is expressed at a cell surface comprises a plasma membrane anchor domain having a transmembrane domain and a cytoplasmic tail that comprises an apoptosis signaling polypeptide, cells in a biological sample may be assayed for translocation of cell membrane phosphatidylserine (PS) from the inner to the outer leaflet of the plasma membrane, which may be detected, for example, by measuring outer leaflet binding by the PS-specific protein annexin. Martin et al., *J. Exp. Med.* 182:1545, 1995; Fadok et al., *J. Immunol.* 148: 2207, 1992. In still other related embodiments of the invention, including embodiments wherein a construct, such as a binding domain-immunoglobulin fusion protein, is expressed at the cell surface and comprises a plasma membrane anchor domain having an apoptosis signaling polypeptide and also including embodiments wherein the construct, such as a binding domain-immunoglobulin fusion protein, is a soluble protein that lacks a membrane anchor domain and that is capable of inducing apoptosis, a cellular response to an apoptogen is determined by an assay for induction of specific protease activity in any member of a family of apoptosis-activated proteases known as the caspases (see, e.g., Green et al., 1998 *Science* 281:1309). Those having ordinary skill in the art will be readily familiar with methods for determining caspase activity, for example by determination of caspase-mediated cleavage of specifically recognized protein substrates. These substrates may include, for example, poly-(ADP-ribose) polymerase (PARP) or other naturally occurring or synthetic peptides and proteins cleaved by caspases that are known in the art (see, e.g., Ellerby et al., 1997 *J. Neurosci.* 17:6165). The synthetic peptide Z-Tyr-Val-Ala-Asp-AFC (SEQ ID NO:528;), wherein "Z" indicates a benzoyl carbonyl moiety and AFC indicates 7-amino-4-trifluoromethylcoumarin (Kluck et al., 1997 *Science* 275:1132; Nicholson et al., 1995 *Nature* 376:37), is one such substrate. Other non-limiting examples of substrates include nuclear proteins such as U1-70 kDa and DNA-PKcs (Rosen and Casciola-Rosen, 1997 *J. Cell. Biochem.* 64:50; Cohen, 1997 *Biochem. J.* 326: 1). Cellular apoptosis may also be detected by determination of cytochrome c that has escaped from mitochondria in apoptotic cells (e.g., Liu et al., *Cell* 86:147, 1996). Such detection of cytochrome c may be performed spectrophotometrically, immunochemically or by other well established methods for determining the presence of a specific protein. Persons having ordinary skill in the art will readily appreciate that there may be other suitable techniques for quantifying apoptosis.

Particularly preferred embodiments of constructs useful for gene therapy applications, including those constructs that include a plasma membrane anchor domain and/or cytoplasmic tail polypeptide (including, for example, an apoptosis signaling sequence), are such constructs that include (1) an immunoglobulin variable region polypeptide sequence, including native or engineered $V_H$ and/or $V_L$ and/or single-chain variable region (sFv) sequences, and which include, for example, a mutation, alteration or deletion at an amino acid at a location or locations corresponding to one or more of amino acid positions 9, 10, 11, 12, 108, 110, 111, and 112, in a $V_H$ region sequence (including in a $V_H$ region sequence within an scFv or other construct), and/or (2) an immunoglobulin variable region polypeptide sequence, including native or engineered $V_H$ and/or $V_L$ and/or single-chain variable region (sFv) sequences, and which include, for example, a mutation, alteration or deletion at a location or locations corresponding to one or more of amino acid positions 12, 80, 81, 82, 83, 105, 106, 107 and 108 in a light chain variable region sequence (including in a $V_L$ region sequence within an scFv or other construct). Especially preferred are constructs that include an engineered $V_H$ sequence (whether or not associated with one or more other sequences, including immunoglobulin-derived and other sequences contained, for example, within an sFv or scFv-containing construct), which includes a mutation, alteration or deletion at an amino acid at a location or locations corresponding to amino acid position 11. The $V_H11$ amino acid, if substituted, may be substituted with another amino acid as described herein, or by another molecule as desired.

Once a construct, such as for example a binding domain-immunoglobulin fusion protein, as provided herein has been designed, polynucleotides including DNAs encoding the construct, where it or a relevant portion of it is a polypeptide, may be synthesized in whole or in part via oligonucleotide synthesis as described, for example, in Sinha et al., *Nucleic Acids Res.*, 12:4539-4557 (1984); assembled via PCR as described, for example in Innis, Ed., *PCR Protocols*, Academic Press (1990) and also in Better et al. *J. Biol. Chem.* 267:16712-16118 (1992); cloned and expressed via standard procedures as described, for example, in Ausubel et al., Eds., *Current Protocols in Molecular Biology*, John Wiley & Sons, New York (1989) and also in Robinson et al., *Hum. Antibod. Hybridomas*, 2:84-93 (1991); and tested for desired activity, for example, binding to a target, or specific antigen binding activity, as described, for example, in Harlow et al., Eds., *Antibodies: A Laboratory Manual*, Chapter 14, Cold Spring Harbor Laboratory, Cold Spring Harbor (1988) and Munson et al., *Anal. Biochem.*, 107:220-239 (1980).

The preparation of single polypeptide chain binding molecules of the Fv region, single-chain Fv molecules, is known in the art. See, e.g., U.S. Pat. No. 4,946,778. In the present invention, single-chain Fv-like molecules that may be included in constructs of the invention may be synthesized by encoding a first variable region of the heavy or light chain, followed by one or more linkers to the variable region of the corresponding light or heavy chain, respectively. The selection of various appropriate linker(s) between the two variable regions is described in U.S. Pat. No. 4,946,778 (see also, e.g., Huston et al., 1993 *Int. Rev. Immunol.* 10:195). An exemplary linker described herein is (Gly-Gly-Gly-Gly-Ser)$_3$ (SEQ ID NO:529), but may be of any desired length. The linker is used to convert the naturally aggregated but chemically separate heavy and light chains into the amino terminal antigen binding portion of a single polypeptide chain, for example, wherein this antigen binding portion will fold into a structure similar to the original structure made of two polypeptide chains, or that otherwise has the ability to bind to a target, for example a target antigen. For those constructs that include an scFv as a binding region, a native or engineered immunoglobulin hinge as a connecting region, and one or more native or engineered heavy chain constant regions as a binding region, nucleotide sequences encoding the variable regions of native or engineered heavy and light chains, joined by a sequence encoding a linker, are joined to a nucleotide sequence encoding native or engineeredantibody constant regions, as desired. The constant regions may be those that permit the resulting polypeptide to form interchain disulfide bonds to form a dimer, and which contain desired effector functions, such as the ability to mediate ADCC, CDC, or fix complement, although native or engineered constant regions that do not favor dimer or other multimer fomation or aggregation are preferred. For a construct, such as an immunoglobulin-like molecule, of the invention that is intended for use in humans, the included sequences having constant regions and/or desired constant regions function(s) will typically be human or substantially human or humanized to minimize a potential anti-human immune response and to provide appropriate or desired effector functions. Manipulation of sequences encoding antibody constant regions is referenced in the PCT publication of Morrison and Oi, WO 89/07142. In preferred embodiments, the CH1 domain is deleted in whole or in part from a tail region that includes, or consists essentially of, or consists of, a native or engineered immunoglobulin constant region(s) (for example, native or engineered CH2 and/or CH3 constant region(s), or native or engineered CH2 and/or CH3 and/or CH4 constant region(s)), and the carboxyl end of the binding region, for example, a binding domain polypeptide such as an immunoglobulin variable region polypeptide, is joined to the amino terminus of, for example, a CH2 via a connecting region, for example, a native or engineered hinge region polypeptide as provided herein.

As described above, the present invention provides recombinant expression constructs capable of directing the expression of constructs of the invention, including binding domain-immunoglobulin fusion proteins, as provided herein. The amino acids, which occur in the various amino acid sequences referred to herein, are identified according to their well known three-letter or single-letter abbreviations. The nucleotides, which occur in the various DNA sequences or fragments thereof referred herein, are designated with the standard single letter designations used routinely in the art. A given amino acid sequence may also encompass similar but changed amino acid sequences, such as those having only minor changes, for example by way of illustration and not limitation, covalent chemical modifications, insertions, deletions and substitutions, which may further include conservative substitutions or substitutions with non-naturally-occurring amino acids. Amino acid sequences that are similar to one another may share substantial regions of sequence homology. In like fashion, nucleotide sequences may encompass substantially similar nucleotide sequences having only minor changes, for example by way of illustration and not limitation, covalent chemical modifications, insertions, deletions and substitutions, which may further include silent mutations owing to degeneracy of the genetic code. Nucleotide sequences that are similar to one another may share substantial regions of sequence homology.

The presence of a malignant condition in a subject refers to the presence of dysplastic, cancerous, and/or transformed cells in the subject, including, for example, neoplastic, tumor, non-contact inhibited, or oncogenically transformed cells, or the like (e.g., melanoma, carcinomas such as adenocarcinoma, squamous cell carcinoma, small cell carcinoma, oat cell carcinoma, etc., sarcomas such as chondrosarcoma, osteosarcoma, etc.) which are known to the art and for which criteria for diagnosis and classification are established. In preferred embodiments contemplated by the present invention, for example, such cancer cells are malignant hematopoietic cells, such as transformed cells of lymphoid lineage and in particular, B cell lymphomas and the like; cancer cells may in certain preferred embodiments also be epithelial cells such as carcinoma cells. The invention also contemplates B cell disorders, which may include certain malignant conditions that affect B cells (e.g., B cell lymphoma) but which is not intended to be so limited, and which is also intended to encompass autoimmune diseases and in particular, diseases, disorders and conditions that are characterized by autoantibody production, for example.

Autoantibodies are antibodies that react with self-antigens. Autoantibodies are detected in several autoimmune diseases (i.e., a disease, disorder or condition wherein a host immune system generates an inappropriate anti-"self" immune reaction) where they are involved in disease activity. Current treatments for various autoimmune diseases include immunosuppressive drugs that require continuing administration, lack specificity, and cause significant side effects. New approaches that can eliminate autoantibody production with minimal toxicity will address an unmet medical need for a spectrum of diseases that affect many people. Constructs of the subject invention, including binding domain-immunoglobulin fusion proteins, are designed, for example, for improved penetration into lymphoid tissues. Depletion of B lymphocytes interrupts the autoantibody production cycle, and allows the immune system to reset as new B lymphocytes are produced from precursors in the bone marrow.

A number of diseases, disorders, and conditions have been identified for which beneficial effects are believed, according to non-limiting theory, to result from B cell depletion therapy. Such diseases disorders, and conditions include, but are not limited to, Grave's disease, Hashimoto's disease, rheumatoid arthritis, systemic lupus erythematosus, Sjogrens Syndrome Immune Thrombocytopenic purpura, multiple sclerosis, myasthenia gravis, scleroderma, psoriasis, Inflamatory Bowel Disease including Crohn's disease and ulcerative colitis. Inflamatory Bowel Disease including Crohn's disease and Ulcerative colitis, are autoimmune diseases of the digestive system.

The present invention further relates to nucleotide constructs encoding constructs of the invention, for example, binding domain-immunoglobulin fusion proteins, and in particular to methods for administering recombinant constructs encoding such proteins for gene therapy applications that may be expressed, for example, as fragments, analogs and derivatives of such polypeptides.

The terms "fragment," "derivative" and "analog" when referring to constructs of the invention including, for example, binding domain-immunoglobulin fusion polypeptides or fusion proteins, refers to any construct, such as a binding domain-immunoglobulin fusion polypeptide or fusion protein, that retains essentially the same biological function or activity as such polypeptide. Thus, an analog includes a pro- or prepro-form of a construct, for example, a pro-protein that can be activated by cleavage of the proprotein portion to produce an active construct, such as a binding domain-immunoglobulin fusion polypeptide.

A fragment, derivative or analog of a construct of the invention, for example, a binding domain-immunoglobulin fusion polypeptide or fusion protein, including binding domain-immunoglobulin fusion polypeptides or fusion proteins encoded by the cDNAs referred to herein, may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which additional amino acids are fused or otherwise connected to the construct, e.g., a binding domain-immunoglobulin fusion polypeptide, including amino acids that are employed for detection or specific functional alteration of the construct, inlcuding such constructs as a binding domain-immunoglobulin fusion polypeptide or a proprotein sequence. Such fragments, derivatives and analogs are deemed to be within the scope of those skilled in the art from the teachings herein.

The constructs, including polypeptide constructs, of the present invention include, for example, binding domain-immunoglobulin fusion polypeptides and fusion proteins having binding regions such as binding domain polypeptide amino acid sequences that are identical or similar to sequences known in the art, or fragments or portions thereof. For example by way of additional illustration and not limitation, a human CD154 molecule extracellular domain is contemplated for use according to the instant invention, as are portions of such polypeptides and/or polypeptides having at least about 70% similarity (preferably greater than a 70% identity) and more preferably about 90% similarity (more preferably greater than a 90% identity) to the reported polypeptide and still more preferably about 95% similarity (still more preferably greater than a 95% identity) to the reported polypeptides and to portions of such polypeptides, wherein such portions of a binding domain-immunoglobulin fusion polypeptide, for example, generally contain at least about 30 amino acids and more preferably at least about 50 amino acids. Extracellular domains include, for example, portions of a cell surface molecule, and in particularly preferred embodiments cell surface molecules that are integral membrane proteins or that comprise a plasma membrane spanning transmembrane domain, that are constructed to extend beyond the outer leaflet of the plasma membrane phospholipid bilayer when the molecule is expressed at a cell surface, preferably in a manner that exposes the extracellular domain portion of such a molecule to the external environment of the cell, also known as the extracellular milieu. Methods for determining whether a portion of a cell surface molecule comprises an extracellular domain are well known to the art and include, for example, experimental determination (e.g., direct or indirect labeling of the molecule, evaluation of whether the molecule can be structurally altered by agents to which the plasma membrane is not permeable such as proteolytic or lipolytic enzymes) or topological prediction based on the structure of the molecule (e.g., analysis of the amino acid sequence of a polypeptide) or other methodologies.

As used herein, an "amino acid" is a molecule having the structure wherein a central carbon atom (the alpha ($\alpha$)-carbon atom) is linked to a hydrogen atom, a carboxylic acid group (the carbon atom of which is referred to herein as a "carboxylcarbon atom"), an amino group (the nitrogen atom of which is referred to herein as an "amino nitrogen atom"), and a side chain group, R. When incorporated into a peptide, polypeptide, or protein, an amino acid loses one or more atoms of its amino and carboxylic groups in the dehydration reaction that links one amino acid to another. As a result, when incorporated into a protein, an amino acid may also be referred to as an "amino acid residue." In the case of naturally occurring proteins, an amino acid residue's R group differentiates the 20 amino acids from which proteins are typically synthesized, although one or more amino acid residues in a protein may be derivatized or modified following incorporation into protein in biological systems (e.g., by glycosylation and/or by the formation of cystine through the oxidation of the thiol side chains of two non-adjacent cysteine amino acid residues, resulting in a disulfide covalent bond that frequently plays an important role in stabilizing the folded conformation of a protein, etc.). As those in the art will appreciate, non-naturally occurring amino acids can also be incorporated into proteins, particularly those produced by synthetic methods, including solid state and other automated synthesis methods. Examples of such amino acids include, without limitation, $\alpha$-amino isobutyric acid, 4-amino butyric acid, L-amino butyric acid, 6-amino hexanoic acid, 2-amino isobutyric acid, 3-amino propionic acid, ornithine, norlensine, norvaline, hydroxyproline, sarcosine, citralline, cysteic acid, t-butylglyine, t-butylalanine, phenylylycine, cyclohexylalanine, 13-alanine, fluoro-amino acids, designer amino acids (e.g., $\beta$-methyl amino acids, $\alpha$-methyl amino acids, N$\alpha$-methyl amino acids) and amino acid analogs in general. In addition, when an $\alpha$-carbon atom has four different groups (as is the case with the 20 amino acids used by biological systems to synthesize proteins, except for glycine, which has two hydrogen atoms bonded to the $\alpha$ carbon atom), two different enantiomeric forms of each amino acid exist, designated D and L. In mammals, only L-amino acids are incorporated into naturally occurring polypeptides. The instant invention envisions proteins incorporating one or more D- and L-amino acids, as well as proteins comprised of just D- or L-amino acid residues.

Herein, the following abbreviations may be used for the following amino acids (and residues thereof): alanine (Ala, A); arginine (Arg, R); asparagine (Asn, N); aspartic acid (Asp, D); cyteine (Cys, C); glycine (Gly, G); glutamic acid (Glu, E); glutamine (Gln, Q); histidine (His, H); isoleucine (Ile, I); leucine (Leu, L); lysine (Lys, K); methionine (Met, M); phenylalanine (Phe, F); proline (Pro, P); serine (Ser, S); threonine (Thr, T); tryptophan (Trp, W); tyrosine (Tyr, Y); and valine (Val, V). Non-polar (hydrophobic) amino acids include alanine, leucine, isoleucine, valine, proline, phenylalanine, tryptophan, and methionines. Neutral amino acids include glycine, serine, threonine, cysteine, tyrosine, esparagine, and glutamine. Positively charged (basic amino acids include arginine, lysine and histidine. Negatively charged (acidic) amino acids include aspartic acid and glutamic acid.

"Protein" refers to any polymer of two or more individual amino acids (whether or not naturally occurring) linked via a peptide bond, and occurs when the carboxylcarbon atom of the carboxylic acid group bonded to the $\alpha$-carbon of one amino acid (or amino acid residue) becomes covalently bound to the amino nitrogen atom of amino group bonded to the $\alpha$-carbon of an adjacent amino acid. The term "protein" is understood to include the terms "polypeptide" and "peptide" (which, at times, may be used interchangeably herein) within its meaning In addition, proteins comprising multiple polypeptide subunits or other components will also be understood to be included within the meaning of "protein" as used herein. Similarly, fragments of proteins, peptides, and polypeptides are also within the scope of the invention and may be referred to herein as "proteins."

In biological systems (be they in vivo or in vitro, including cell-free, systems), the particular amino acid sequence of a given protein (i.e., the polypeptide's "primary structure," when written from the amino-terminus to carboxy-terminus) is determined by the nucleotide sequence of the coding portion of a mRNA, which is in turn specified by genetic information, typically genomic DNA (which, for purposes of this invention, is understood to include organelle DNA, for example, mitochondrial DNA and chloroplast DNA). Of course, any type of nucleic acid which constitutes the genome of a particular organism (e.g., double-stranded DNA in the case of most animals and plants, single or double-stranded RNA in the case of some viruses, etc.) is understood to code for the gene product(s) of the particular organism. Messenger RNA is translated on a ribosome, which catalyzes the polymerization of a free amino acid, the particular identity of which is specified by the particular codon (with respect to mRNA, three adjacent A, G, C, or U ribonucleotides in the mRNA's coding region) of the mRNA then being translated, to a nascent polypeptide. Recombinant DNA techniques have enabled the large-scale synthesis of proteins and polypeptides (e.g., human insulin, human growth hormone, erythropoietin, granulocyte colony stimulating factor, etc.) having the same primary sequence as when produced naturally in living organisms. In addition, such technology has allowed the synthesis of analogs of these and other proteins, which analogs may contain one or more amino acid deletions, insertions, and/or substitutions as compared to the native proteins. Recombinant DNA technology also enables the synthesis of entirely novel proteins.

In non-biological systems (e.g., those employing solid state synthesis), the primary structure of a protein (which also includes disulfide (cystine) bond locations) can be determined by the user. As a result, polypeptides having a primary structure that duplicates that of a biologically produced protein can be achieved, as can analogs of such proteins. In addition, completely novel polypeptides can also be synthesized, as can protein incorporating non-naturally occurring amino acids.

As is known in the art, "similarity" between two polypeptides may be determined by comparing the amino acid sequence (including conserved amino acid substitutes therein) of one polypeptide to the sequence of a second polypeptide. Fragments or portions of the nucleic acids encoding polypeptides of the present invention may be used to synthesize full-length nucleic acids of the present invention. As used herein, "% identity" refers to the percentage of identical amino acids situated at corresponding amino acid residue positions when two or more polypeptide are aligned and their sequences analyzed using, for example, a gapped BLAST algorithm (e.g., Altschul et al., 1997 *Nucl. Ac. Res.* 25:3389; Altschul et al., 1990 *J. Mol. Biol.,* 215:403-410) which weights sequence gaps and sequence mismatches according to the default weightings provided by the National Institutes of Health/NCBI database (Bethesda, Md.; see www.ncbi.nlm.nih.gov/cgi-bin/BLAST/nph-newblast).
Other alignment methods include BLITZ (MPsrch) (Sturrock & Collins, 1993), and FASTA (Pearson and Lipman, 1988 *Proc. Natl. Acad. Sci. USA.* 85:2444-2448).

The term "isolated" means, in the case of a naturally occurring material, that the material is or has been removed from, or is no longer associated with, its natural or original environment. For example, a naturally occurring nucleic acid or protein or polypeptide present in a living animal is not isolated, but the same nucleic acid or polypeptide, separated from some or all of the co-existing materials in the natural system, is isolated. Such nucleic acids could be part of a vector and/or such nucleic acids or polypeptides could be part of a composition, and still be isolated in that such vector or composition is not part of its natural environment. The term "isolated", in the case of non-naturally occurring material, such as a recombinantly manufactured construct of the invention, includes material that is substantially or essentially free from components which normally accompany it during manufacture, such as, for example, proteins and peptides that have been purified to a desired degree, preferably, for example, so that they are at least about 80% pure, more preferably at least about 90%, and still more preferably at least about 95% as measured by techniques known in the art.

The term "gene" means a segment of DNA involved in producing a polypeptide chain; it may also include regions preceding and following a polypeptide coding region, for example, a "leader and trailer" as well as intervening sequences (introns) between relevant individual coding segments (exons).

As described herein, the invention provides constructs, including binding domain-immunoglobulin fusion proteins, that may be encoded in whole or in part by nucleic acids that have a binding region coding sequence such as, for example, a binding domain coding sequence fused or otherwise connected in frame to an additional native or engineered immunoglobulin domain encoding sequence to provide for expression of, for example, a binding domain polypeptide sequence fused or otherwise connected to an additional functional polypeptide sequence that permits, for example by way of illustration and not limitation, detection, functional alteration, isolation and/or purification of the fusion protein. Such fusion proteins may permit functional alteration of a binding domain by containing additional immunoglobulin-derived polypeptide sequences that influence behavior of the fusion product, for example (and as described above) by reducing the availability of sufhydryl groups for participation in disulfide bond formation, and by conferring the ability to potentiate ADCC and/or CDC and/or fix complement.

Modification of a polypeptide may be effected by any means known to those of skill in this art. The preferred methods herein rely on modification of DNA encoding, for example, a fusion protein and expression of the modified DNA. DNA encoding one of the constructs of the invention, for example, one of the binding domain-immunoglobulin fusions discussed herein, for example, may be altered or mutagenized using standard methodologies, including those described below. For example, cysteine residues that may otherwise facilitate multimer formation or promote particular molecular conformations can be deleted from a polypeptide or replaced, e.g., cysteine residues that are responsible for or participate in aggregate formation. If necessary, for example, the identity of cysteine residues that contribute to aggregate formation may be determined empirically, by deleting and/or replacing a cysteine residue and ascertaining whether the resulting protein aggregates in solutions containing physiologically acceptable buffers and salts. In addition, fragments of, for example, binding domain-immunoglobulin fusions may be constructed and used. As noted above, counterreceptor/ligand binding domains for many candidate binding domain-immunoglobulin fusion have been delineated, such that one having ordinary skill in the art may readily select appropriate polypeptide domains for inclusion in encoded products of the instant expression constructs.

Conservative substitutions of amino acids are well known and may be made generally without altering the biological activity of the resulting binding domain-immunoglobulin fusion protein molecule. For example, such substitutions are generally made by interchanging within the groups of polar residues, charged residues, hydrophobic residues, small residues, and the like. If necessary, such substitutions may be determined empirically merely by testing the resulting modified protein for the ability to bind to the appropriate cell surface receptors in in vitro biological assays, or to bind to appropriate antigens or desired target molecules.

The present invention further relates to nucleic acids which hybridize to constructs of the invention, including for example, binding domain-immunoglobulin fusion protein encoding polynucleotide sequences as provided herein, or their complements, as will be readily apparent to those familiar with the art, if there is at least 70%, preferably at least about 80-85%, more preferably at least about 90%, and still more preferably at least about 95%, 96%, 97%, 98% or 99% identity between the sequences.

The present invention particularly relates to nucleic acids that hybridize under stringent conditions to, for example, the binding domain-immunoglobulin fusion encoding nucleic acids referred to herein. As used herein, to "hybridize" under conditions of a specified stringency is used to describe the stability of hybrids formed between two single-stranded nucleic acid molecules. Stringency of hybridization is typically expressed in conditions of ionic strength and temperature at which such hybrids are annealed and washed. The term "stringent conditions" refers to conditions that permit hybridization between polynucleotides. Stringent conditions can be defined by salt concentration, the concentration of organic solvent (e.g., formamide), temperature, and other conditions well known in the art. In particular, stringency can be increased by reducing the concentration of salt, increasing the concentration of organic solvents (e.g., formamide), or raising the hybridization temperature. For example, stringent salt concentration will ordinarily be less than about 750 mM NaCl and 75 mM trisodium citrate, preferably less than about 500 mM NaCl and 50 mM trisodium citrate, and most preferably less than about 250 mM NaCl and 25 mM trisodium citrate. Low stringency hybridization can be obtained in the absence of organic solvent, e.g., formamide, while high stringency hybridization can be obtained in the presence of an organic solvent (e.g., at least about 35% formamide, most preferably at least about 50% formamide). Stringent temperature conditions will ordinarily include temperatures of at least about 30° C., more preferably of at least about 37° C., and most preferably of at least about 42° C. Varying additional parameters, for example, hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed, and are within the skill in the art. Other typical "high", "medium" and "low" stringency encompass the following conditions or equivalent conditions thereto: high stringency: 0.1×SSPE or SSC, 0.1% SDS, 65° C.; medium stringency: 0.2×SSPE or SSC, 0.1% SDS, 50° C.; and low stringency: 1.0×SSPE or SSC, 0.1% SDS, 50° C. As known to those having ordinary skill in the art, variations in stringency of hybridization conditions may be achieved by altering the time, temperature and/or concentration of the solutions used for prehybridization, hybridization and wash steps, and suitable conditions may also depend in part on the particular nucleotide sequences of the probe used, and of the blotted, proband nucleic acid sample. Accordingly, it will be appreciated that suitably stringent conditions can be readily selected without undue experimentation where a desired selectivity of the probe is identified, based on its ability to hybridize to one or more certain proband sequences while not hybridizing to certain other proband sequences.

As used herein, preferred "stringent conditions" generally refer to hybridization that will occur only if there is at least about 90-95% and more preferably at least about 97% identity between the sequences. The nucleic acid constructs which hybridize to, for example, binding domain-immunoglobulin fusion encoding nucleic acids referred to herein, in preferred embodiments, encode polypeptides which retain substantially the same biological function or activity as, for example, the binding domain-immunoglobulin fusion polypeptides encoded by the cDNAs.

The nucleic acids of the present invention, also referred to herein as polynucleotides, may be in the form of RNA, for example, mRNA, or in the form of DNA, which DNA includes cDNA (also called "complementary DNA", which is a DNA molecule that is complementary to a specific messenger RNA), genomic DNA, and synthetic DNA. The DNA may be double-stranded or single-stranded, and if single stranded may be the coding strand or non-coding (anti-sense) strand. A coding sequence which encodes a construct of the invention, for example, a binding domain-immunoglobulin fusion polypeptide for use according to the invention may contain portions that are identical to the coding sequence known in the art or described herein for portions thereof, or may be a different coding sequence, which, as a result of the redundancy or degeneracy of the genetic code, encodes the same construct or portion thereof, including all or a portion of a binding domain-immunoglobulin fusion polypeptide.

The nucleic acids which encode constructs of the invention, for example, binding domain-immunoglobulin fusion polypeptides, for use according to the invention may include, but are not limited to: only the coding sequence for the construct, such as a binding domain-immunoglobulin fusion polypeptide; the coding sequence for the construct, such as a binding domain-immunoglobulin fusion polypeptide and additional coding sequence; the coding sequence for the construct, such as a binding domain-immunoglobulin fusion polypeptide (and optionally additional coding sequence) and non-coding sequence, such as introns or non-coding sequences 5' and/or 3' of the coding sequence for the binding domain-immunoglobulin fusion polypeptide or a portion(s) thereof, which for example may further include but need not be limited to one or more regulatory nucleic acid sequences that may be a regulated or regulatable promoter, enhancer, other transcription regulatory sequence, repressor binding sequence, translation regulatory sequence or any other regulatory nucleic acid sequence. Thus, the term "nucleic acid encoding" or "polynucleotide encoding" a construct, for example, a binding domain-immunoglobulin fusion protein, encompasses a nucleic acid which includes only coding sequence for, for example, a binding domain-immunoglobulin fusion polypeptide as well as a nucleic acid which includes additional coding and/or non-coding sequence(s).

Nucleic acids and oligonucleotides for use as described herein can be synthesized by any method known to those of skill in this art (see, e.g., WO 93/01286, U.S. application Ser. No. 07/723,454; U.S. Pat. No. 5,218,088; U.S. Pat. No. 5,175,269; U.S. Pat. No. 5,109,124). Identification of various oligonucleotides and nucleic acid sequences also involves methods known in the art. For example, the desirable properties, lengths and other characteristics of oligonucleotides useful for cloning are well known. In certain embodiments, synthetic oligonucleotides and nucleic acid sequences may be designed that resist degradation by endogenous host cell nucleolytic enzymes by containing such linkages as: phosphorothioate, methylphosphonate, sulfone, sulfate, ketyl, phosphorodithioate, phosphoramidate, phosphate esters, and other such linkages that have proven useful in antisense applications. See, e.g., Agrwal et al., *Tetrehedron Lett.* 28:3539-3542 (1987); Miller et al., *J. Am. Chem. Soc.* 93:6657-6665 (1971); Stec et al., *Tetrehedron Lett.* 26:2191-2194 (1985); Moody et al., *Nucl. Acids Res.* 12:4769-4782 (1989); Uznanski et al., *Nucl. Acids Res.* (1989); Letsinger et al., *Tetrahedron* 40:137-143 (1984); Eckstein, *Annu. Rev. Biochem.* 54:367-402 (1985); Eckstein, *Trends Biol. Sci.* 14:97-100 (1989); Stein In: *Oligodeoxynucleotides. Antisense Inhibitors of Gene Expression*, Cohen, Ed, Macmillan Press, London, pp. 97-117 (1989); Jager et al., *Biochemistry* 27:7237-7246 (1988).

In one embodiment, the present invention provides truncated components (e.g., binding domain polypeptide, hinge region polypeptide, linker, etc.) for use in a construct of the invention, for example, a binding domain-immunoglobulin fusion protein. In another embodiment the invention provides nucleic acids encoding a construct of the invention, for example, a binding domain-immunoglobulin fusion protein having such truncated components. A truncated molecule may be any molecule that comprises less than a full length version of the molecule of interest. Truncated molecules provided by the present invention may include truncated biological polymers, and in preferred embodiments of the invention such truncated molecules may be truncated nucleic acid molecules or truncated polypeptides. Truncated nucleic acid molecules have less than the full length nucleotide sequence of a known or described nucleic acid molecule, where such a known or described nucleic acid molecule may be a naturally occurring, a synthetic, or a recombinant nucleic acid molecule, so long as one skilled in the art would regard it as a full length molecule. Thus, for example, truncated nucleic acid molecules that correspond to a gene sequence contain less than the full length gene where the gene comprises coding and non-coding sequences, promoters, enhancers and other regulatory sequences, flanking sequences and the like, and other functional and non-functional sequences that are recognized as part of the gene. In another example, truncated nucleic acid molecules that correspond to a mRNA sequence contain less than the full length mRNA transcript, which may include various translated and non-translated regions as well as other functional and non-functional sequences.

In other preferred embodiments, truncated molecules are polypeptides that comprise less than the full-length amino acid sequence of a particular protein or polypeptide component. As used herein "deletion" has its common meaning as understood by those familiar with the art, and may refer to molecules that lack one or more portions of a sequence from either terminus or from a non-terminal region, relative to a corresponding full length molecule, for example, as in the case of truncated molecules provided herein. Truncated molecules that are linear biological polymers such as nucleic acid molecules or polypeptides may have one or more of a deletion from either terminus of the molecule and/or one or more deletions from a non-terminal region of the molecule, where such deletions may be deletions of from about 1-1500 contiguous nucleotide or amino acid residues, preferably about 1-500 contiguous nucleotide or amino acid residues and more preferably about 1-300 contiguous nucleotide or amino acid residues, including deletions of about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31-40, 41-50, 51-74, 75-100, 101-150, 151-200, 201-250 or 251-299 contiguous nucleotide or amino acid residues. In certain particularly preferred embodiments truncated nucleic acid molecules may have a deletion of about 270-330 contiguous nucleotides. In certain more preferred embodiments, truncated polypeptide molecules may have a deletion, for example, of about 80-140 contiguous amino acids.

The present invention further relates to variants of the herein referenced nucleic acids that encode fragments, analogs and/or derivatives of a construct of the invention, for example, a binding domain-immunoglobulin fusion polypeptide. The variants of the nucleic acids encoding constructs of the invention, for example, binding domain-immunoglobulin fusion proteins, may be naturally occurring allelic variants of one or more portions of the nucleic acid sequences included therein, or non-naturally occurring variants of such sequences or portions or sequences, including sequences varied by molecular engineering using, for example, methods know in the art for varying sequence. As is known in the art, an allelic variant is an alternate form of a nucleic acid sequence which may have at least one of a substitution, a deletion or an addition of one or more nucleotides, any of which does not substantially or undesireably alter the function of the encoded binding domain-immunoglobulin fusion polypeptide.

Variants and derivatives of constructs of the invention, for example, binding domain-immunoglobulin fusion proteins, may be obtained by mutations of nucleotide sequences encoding, for example, binding domain-immunoglobulin fusion polypeptides or any portion thereof. Alterations of the native amino acid sequence may be accomplished by any of a number of conventional methods. Mutations can be introduced at particular loci, for example, by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion.

Alternatively, for example, oligonucleotide-directed site-specific mutagenesis procedures can be employed to provide an altered gene wherein predetermined codons can be altered by substitution, deletion or insertion. Exemplary methods of making such alterations are disclosed by Walder et al., 1986 *Gene* 42:133; Bauer et al., 1985 *Gene* 37:73; Craik, January 1985 *BioTechniques* 12-19; Smith et al., January 1985 *Genetic Engineering: Principles and Methods BioTechniques* 12-19; Costa G L, et al., "Site-directed mutagenesis using a rapid PCR-based method," 1996 *Methods Mol. Biol.* 57:239-48; Rashtchian A., "Novel methods for cloning and engineering genes using the polymerase chain reaction," 1995 *Curr Opin Biotechnol.* 6(1):30-6; Sharon J, et al., "Oligonucleotide-directed mutagenesis of antibody combining sites," 1993 *Int Rev Immunol.* 10(2-3):113-27; Kunkel, 1985 *Proc. Natl. Acad. Sci. USA* 82:488; Kunkel et al., 1987 *Methods in Enzymol.* 154:367; and, U.S. Pat. Nos. 4,518,584 and 4,737,462.

As an example, modification of DNA may be performed by site-directed mutagenesis of DNA encoding a protein combined with the use of DNA amplification methods using primers to introduce and amplify alterations in the DNA template, such as PCR splicing by overlap extension (SOE). Site-directed mutagenesis is typically effected using a phage vector that has single- and double-stranded forms, such as M13 phage vectors, which are well known and commercially available. Other suitable vectors that contain a single-stranded phage origin of replication may be used. See, e.g., Veira et al., 1987 *Meth. Enzymol.* 15:3. In general, site-directed mutagenesis is performed by preparing a single-stranded vector that encodes the protein of interest (e.g., all or a component portion of a given binding domain-immunoglobulin fusion protein). An oligonucleotide primer that contains the desired mutation within a region of homology to the DNA in the single-stranded vector is annealed to the vector followed by addition of a DNA polymerase, such as *E. coli* DNA polymerase I (Klenow fragment), which uses the double stranded region as a primer to produce a heteroduplex in which one strand encodes the altered sequence and the other the original sequence. The heteroduplex is introduced into appropriate bacterial cells and clones that include the desired mutation are selected. The resulting altered DNA molecules may be expressed recombinantly in appropriate host cells to produce the modified protein.

Equivalent DNA constructs that include code for additions or substitutions of amino acid residues or sequences, or deletions of terminal or internal residues or sequences not needed or desired for biological activity, for example, are also encompassed by the invention. For example, and as discussed above, sequences encoding Cys residues that are not desirable or essential for biological activity can be altered to cause the Cys residues to be deleted or replaced with other amino acids, for example, thus preventing formation of incorrect or undesired intramolecular disulfide bridges upon synthesis or renaturation.

A "host cell" or "recombinant host cell" is a cell that contains a vector, e.g., an expression vector, or a cell that has otherwise been manipulated by recombinant techniques to express a protein of interest. Host organisms include those organisms in which recombinant production of constructs of the invention, for example, binding domain-immunoglobulin fusion products encoded by the recombinant constructs of the present invention may occur, such as bacteria (for example, *E. coli*), yeast (for example, *Saccharomyces cerevisiae* and *Pichia pastoris*), insect cells, and mammalian cells, including in vitro and in vivo expression. Host organisms thus may include organisms for the construction, propagation, expression or other steps in the production of the compositions provided herein. Hosts include subjects in which immune responses take place, as described herein. Presently preferred host organisms for production of constructs of the invention that produce glycosylated proteins are mammalian cells or other cells systems that pemit the expression and recovery of glycosylated proteins. Other cell lines include inbred murine strains and murine cell lines, and human cellsand cell lines.

A DNA construct encoding a desired construct of the invention, for example, a binding domain-immunoglobulin fusion protein is introduced into a vector, for example, a plasmid, for expression in an appropriate host. In preferred embodiments, the host is a mammalian host, for example, a mammalian cell line. The sequence encoding the ligand or nucleic acid binding domain is preferably codon-optimized for expression in the particular host. Thus, for example, if a construct, for example, is a human binding domain-immunoglobulin fusion and is expressed in bacteria, the codons may be optimized for bacterial usage. For small coding regions, the gene can be synthesized as a single oligonucleotide. For larger proteins, splicing of multiple oligonucleotides, mutagenesis, or other techniques known to those in the art may be used. The sequences of nucleotides in plasmids or other vectors that are regulatory regions, such as promoters and operators, are operationally associated with one another for transcription. The sequence of nucleotides encoding a binding domain-immunoglobulin fusion protein may also include DNA encoding a secretion signal, whereby the resulting peptide is a precursor protein. The resulting processed protein may be recovered from the periplasmic space or the fermentation medium.

In preferred embodiments, the DNA plasmids may also include a transcription terminator sequence. As used herein, a "transcription terminator region" is a sequence that signals transcription termination. The entire transcription terminator may be obtained from a protein-encoding gene, which may be the same or different from the inserted binding domain-immunoglobulin fusion encoding gene or the source of the promoter. Transcription terminators are optional components of the expression systems herein, but are employed in preferred embodiments.

The plasmids or other vectors used herein include a promoter in operative association with the DNA encoding the protein or polypeptide of interest and are designed for expression of proteins in a suitable host as described above (e.g., bacterial, murine, or human) depending upon the desired use of the plasmid (e.g., administration of a vaccine containing binding domain-immunoglobulin fusion encoding sequences). Suitable promoters for expression of proteins and polypeptides herein are widely available and are well known in the art. Inducible promoters or constitutive promoters that are linked to regulatory regions are preferred. Such promoters include, for example, but are not limited to, the T7 phage promoter and other T7-like phage promoters, such as the T3, T5 and SP6 promoters, the trp, lpp, and lac promoters, such as the lacUV5, from *E. coli*; the P10 or polyhedrin gene promoter of baculovirus/insect cell expression systems (see, e.g., U.S. Pat. Nos. 5,243,041, 5,242,687, 5,266,317, 4,745,051, and 5,169,784) and inducible promoters from other eukaryotic expression systems. For expression of the proteins such promoters are inserted in a plasmid in operative linkage with a control region such as the lac operon.

Preferred promoter regions are those that are inducible and functional in mammalian cells, for example. Examples of suitable inducible promoters and promoter regions for bacterial expression include, but are not limited to: the *E. coli* lac operator responsive to isopropyl β-D-thiogalactopyranoside (IPTG; see Nakamura et al., 1979 *Cell* 18:1109-1117); the metallothionein promoter metal-regulatory-elements responsive to heavy-metal (e.g., zinc) induction (see, e.g., U.S. Pat. No. 4,870,009); the phage T7lac promoter responsive to IPTG (see, e.g., U.S. Pat. No. 4,952,496; and Studier et al., 1990 *Meth. Enzymol.* 185:60-89) and the TAC promoter. Depending on the expression host system to be used, plasmids may optionally include a selectable marker gene or genes that are functional in the host. Thus, for example, a selectable marker gene includes any gene that confers a phenotype on bacteria that allows transformed bacterial cells to be identified and selectively grown from among a vast majority of untransformed cells. Suitable selectable marker genes for bacterial hosts, for example, include the ampicillin resistance gene ($Amp^r$), tetracycline resistance gene ($Tc^r$) and the kanamycin resistance gene ($Kan^r$). The kanamycin resistance gene is presently preferred for bacterial expression.

In various expression systems, plasmids or other vectors may also include DNA encoding a signal for secretion of the operably linked protein. Secretion signals suitable for use are widely available and are well known in the art. Prokaryotic and eukaryotic secretion signals functional in *E. coli* may be employed. Depending on the expression systems, presently preferred secretion signals may include, but are not limited to, those encoded by the following *E. coli* genes: ompA, ompT, ompF, ompC, beta-lactamase, and alkaline phosphatase, and the like (von Heijne, *J. Mol. Biol.* 184:99-105, 1985). In addition, the bacterial pelB gene secretion signal (Lei et al., *J. Bacteriol.* 169:4379, 1987), the phoA secretion signal, and the cek2 functional in insect cell may be employed. The most preferred secretion signal for certain expression systems is the *E. coli* ompA secretion signal. Other prokaryotic and eukaryotic secretion signals known to those of skill in the art may also be employed (see, e.g., von Heijne, *J. Mol. Biol.*

184:99-105, 1985). Using the methods described herein, one of skill in the art can substitute secretion signals that are functional, for example, in yeast, insect or mammalian cells to secrete proteins from those cells.

Preferred plasmids for transformation of *E. coli* cells include the pET expression vectors (e.g., pET-11a, pET-12a-c, pET-15b; see U.S. Pat. No. 4,952,496; available from Novagen, Madison, Wis.). Other preferred plasmids include the pKK plasmids, particularly pKK 223-3, which contains the tac promoter (Brosius et al., 1984 *Proc. Natl. Acad. Sci.* 81:6929; Ausubel et al., *Current Protocols in Molecular Biology*; U.S. Pat. Nos. 5,122,463, 5,173,403, 5,187,153, 5,204,254, 5,212,058, 5,212,286, 5,215,907, 5,220,013, 5,223,483, and 5,229,279). Plasmid pKK has been modified by replacement of the ampicillin resistance gene with a kanamycin resistance gene. (Available from Pharmacia; obtained from pUC4K, see, e.g., Vieira et al. (1982 *Gene* 19:259-268; and U.S. Pat. No. 4,719,179.) Baculovirus vectors, such as pBlueBac (also called pJVETL and derivatives thereof), particularly pBlueBac III (see, e.g., U.S. Pat. Nos. 5,278,050, 5,244,805, 5,243,041, 5,242,687, 5,266,317, 4,745,051, and 5,169,784; available from Invitrogen, San Diego) may also be used for expression of the polypeptides in insect cells. Other plasmids include the pIN-IIIompA plasmids (see U.S. Pat. No. 4,575,013; see also Duffaud et al., *Meth. Enz.* 153:492-507, 1987), such as pIN-IIIompA2.

Preferably, if one or more DNA molecules is replicated in bacterial cells, the preferred host is *E. coli*. The preferred DNA molecule is such a system also includes a bacterial origin of replication, to ensure the maintenance of the DNA molecule from generation to generation of the bacteria. In this way, large quantities of the DNA molecule can be produced by replication in bacteria. In such expression systems, preferred bacterial origins of replication include, but are not limited to, the fl-ori and col E1 origins of replication. Preferred hosts for such systems contain chromosomal copies of DNA encoding T7 RNA polymerase operably linked to an inducible promoter, such as the lacUV promoter (see U.S. Pat. No. 4,952,496). Such hosts include, but are not limited to, lysogens *E. coli* strains HMS174(DE3)pLysS, BL21(DE3) pLysS, HMS174(DE3) and BL21(DE3). Strain BL21(DE3) is preferred. The pLys strains provide low levels of T7 lysozyme, a natural inhibitor of T7 RNA polymerase.

The DNA molecules provided may also contain a gene coding for a repressor protein. The repressor protein is capable of repressing the transcription of a promoter that contains sequences of nucleotides to which the repressor protein binds. The promoter can be derepressed by altering the physiological conditions of the cell. For example, the alteration can be accomplished by adding to the growth medium a molecule that inhibits the ability to interact with the operator or with regulatory proteins or other regions of the DNA or by altering the temperature of the growth media. Preferred repressor proteins include, but are not limited to the *E. coli* lad repressor responsive to IPTG induction, the temperature sensitive λ cI857 repressor, and the like. The *E. coli* lad repressor is preferred.

In general, recombinant constructs of the subject invention will also contain elements necessary for transcription and translation. In particular, such elements are preferred where the recombinant expression construct containing nucleic acid sequences encoding binding domain-immunoglobulin fusion proteins is intended for expression in a host cell or organism. In certain embodiments of the present invention, cell type preferred or cell type specific expression of a cell binding domain-immunoglobulin fusion encoding gene may be achieved by placing the gene under regulation of a promoter. The choice of the promoter will depend upon the cell type to be transformed and the degree or type of control desired. Promoters can be constitutive or active and may further be cell type specific, tissue specific, individual cell specific, event specific, temporally specific or inducible. Cell-type specific promoters and event type specific promoters are preferred. Examples of constitutive or nonspecific promoters include the SV40 early promoter (U.S. Pat. No. 5,118,627), the SV40 late promoter (U.S. Pat. No. 5,118,627), CMV early gene promoter (U.S. Pat. No. 5,168,062), and adenovirus promoter. In addition to viral promoters, cellular promoters are also amenable within the context of this invention. In particular, cellular promoters for the so-called housekeeping genes are useful. Viral promoters are preferred, because generally they are stronger promoters than cellular promoters. Promoter regions have been identified in the genes of many eukaryotes including higher eukaryotes, such that suitable promoters for use in a particular host can be readily selected by those skilled in the art.

Inducible promoters may also be used. These promoters include MMTV LTR (PCT WO 91/13160), inducible by dexamethasone; metallothionein promoter, inducible by heavy metals; and promoters with cAMP response elements, inducible by cAMP. By using an inducible promoter, the nucleic acid sequence encoding a binding domain-immunoglobulin fusion protein may be delivered to a cell by the subject invention expression construct and will remain quiescent until the addition of the inducer. This allows further control on the timing of production of the gene product.

Event-type specific promoters are active or up regulated only upon the occurrence of an event, such as tumorigenicity or viral infection. The HIV LTR is a well-known example of an event-specific promoter. The promoter is inactive unless the tat gene product is present, which occurs upon viral infection. Some event-type promoters are also tissue-specific.

Additionally, promoters that are coordinately regulated with a particular cellular gene may be used. For example, promoters of genes that are coordinately expressed may be used when expression of a particular binding construct of the invention, for example, a binding domain-immunoglobulin fusion protein-encoding gene is desired in concert with expression of one or more additional endogenous or exogenously introduced genes. This type of promoter is especially useful when one knows the pattern of gene expression relevant to induction of an immune response in a particular tissue of the immune system, so that specific immunocompetent cells within that tissue may be activated or otherwise recruited to participate in the immune response.

In addition to the promoter, repressor sequences, negative regulators, or tissue-specific silencers may be inserted to reduce non-specific expression of binding domain-immunoglobulin fusion protein encoding genes in certain situations, such as, for example, a host that is transiently immunocompromised as part of a therapeutic strategy. Multiple repressor elements may be inserted in the promoter region. Repression of transcription is independent on the orientation of repressor elements or distance from the promoter. One type of repressor sequence is an insulator sequence. Such sequences inhibit transcription (Dunaway et al., 1997 *Mol Cell Biol* 17: 182-9; Gdula et al., 1996 *Proc Natl Acad Sci USA* 93:9378-83, Chan et al., 1996 *J Virol* 70: 5312-28; Scott and Geyer, 1995 *EMBO J.* 14:6258-67; Kalos and Fournier, 1995 *Mol Cell Biol* 15:198-207; Chung et al., 1993 *Cell* 74: 505-14) and will silence undesired background transcription.

Repressor elements have also been identified in the promoter regions of the genes for type II (cartilage) collagen, choline acetyltransferase, albumin (Hu et al., 1992 *J. Cell*

*Growth Differ.* 3(9):577-588), phosphoglycerate kinase (PGK-2) (Misuno et al., 1992 *Gene* 119(2):293-297), and in the 6-phosphofructo-2-kinase/fructose-2,6-bisphosphatase gene. (Lemaigre et al., *Mol. Cell. Biol.* 11(2):1099-1106). Furthermore, the negative regulatory element Tse-1 has been identified in a number of liver specific genes, and has been shown to block cAMP response element(CRE)-mediated induction of gene activation in hepatocytes. (Boshart et al., 1990 *Cell* 61(5):905-916,).

In preferred embodiments, elements that increase the expression of the desired product are incorporated into the construct. Such elements include internal ribosome binding sites (IRES; Wang and Siddiqui, 1995 *Curr. Top. Microbiol. Immunol* 203:99; Ehrenfeld and Semler, 1995 *Curr. Top. Microbiol. Immunol.* 203:65; Rees et al., 1996 *Biotechniques* 20:102; Sugimoto et al., 1994 *Biotechnology* 12:694). IRES increase translation efficiency. As well, other sequences may enhance expression. For some genes, sequences especially at the 5' end inhibit transcription and/or translation. These sequences are usually palindromes that can form hairpin structures. Any such sequences in the nucleic acid to be delivered are generally deleted. Expression levels of the transcript or translated product are assayed to confirm or ascertain which sequences affect expression. Transcript levels may be assayed by any known method, including Northern blot hybridization, RNase probe protection and the like. Protein levels may be assayed by any known method, including ELISA, western blot, immunocytochemistry or other well-known techniques.

Other elements may be incorporated into the constructs of the invention, for example, into binding domain-immunoglobulin fusion protein encoding constructs of the present invention. In preferred embodiments, the construct includes a transcription terminator sequence, including a polyadenylation sequence, splice donor and acceptor sites, and an enhancer. Other elements useful for expression and maintenance of the construct in mammalian cells or other eukaryotic cells may also be incorporated (e.g., origin of replication). Because the constructs are conveniently produced in bacterial cells, elements that are necessary for, or that enhance, propagation in bacteria are incorporated. Such elements include an origin of replication, a selectable marker and the like.

As provided herein, an additional level of controlling the expression of nucleic acids encoding constructs of the invention, for example, binding domain-immunoglobulin fusion proteins, delivered to cells for gene therapy, for example, may be provided by simultaneously delivering two or more differentially regulated nucleic acid constructs. The use of such a multiple nucleic acid construct approach may permit coordinated regulation of an immune response such as, for example, spatiotemporal coordination that depends on the cell type and/or presence of another expressed encoded component. Those familiar with the art will appreciate that multiple levels of regulated gene expression may be achieved in a similar manner by selection of suitable regulatory sequences, including but not limited to promoters, enhancers and other well known gene regulatory elements.

The present invention also relates to vectors, and to constructs prepared from known vectors that include nucleic acids of the present invention, and in particular to "recombinant expression constructs", including any of various known constructs, including delivery constructs, useful for gene therapy, that include any nucleic acids encoding, for example, binding domain-immunoglobulin fusion proteins and polypeptides according to the invention as provided herein; to host cells which are genetically engineered with vectors and/or other constructs of the invention and to methods of administering expression or other constructs comprising nucleic acid sequences encoding, for example, binding domain-immunoglobulin fusion polypeptides and fusion proteins of the invention, or fragments or variants thereof, by recombinant techniques.

Various constructs of the invention, including for example, binding domain-immunoglobulin fusion proteins, can be expressed in virtually any host cell, including in vivo host cells in the case of use for gene therapy, under the control of appropriate promoters, depending on the nature of the construct (e.g., type of promoter, as described above), and on the nature of the desired host cell (e.g., whether postmitotic terminally differentiated or actively dividing; e.g., whether the expression construct occurs in host cell as an episome or is integrated into host cell genome).

Appropriate cloning and expression vectors for use with prokaryotic and eukaryotic hosts are described, for example, by Sambrook, et al., *Molecular Cloning: A Laboratory Manual*, Second Edition, Cold Spring Harbor, N.Y., (1989); as noted herein, in particularly preferred embodiments of the invention, recombinant expression is conducted in mammalian cells that have been transfected or transformed with the subject invention recombinant expression construct. See also, for example, Machida, Calif., "Viral Vectors for Gene Therapy Methods and Protocols"; Wolff, J A, "Gene Therapeutics: Methods and Applications of Direct Gene Transfer" (Birkhauser 1994); Stein, U and Walther, W (eds. P, "Gene Therapy of Cancer: Methods and Protocols" (Humana Press 2000); Robbins, PD (ed.), "Gene Therapy Protocols" (Humana Press 1997); Morgan, J R (ed.), "Gene Therapy Protocols" (Humana Press 2002); Meager, A (ed.), "Gene Therapy Technologies, Applications and Regulations: From Laboratory to Clinic" (John Wiley & Sons Inc. 1999); MacHida, C A and Constant, J G, "Viral Vectors for Gene Therapy: Methods and Protocols" (Humana Press 2002); "New Methods Of Gene Therapy For Genetic Metabolic Diseases NIH Guide," Volume 22, Number 35, Oct. 1, 1993. See also recent U.S. patents relating to gene therapy, including vaccines, which include U.S. Pat. Nos. 6,384,210 ("Solvent for biopolymer synthesis, solvent microdroplets and methods of use"); 6,384,203 ("Family of immunoregulators designated leukocyte immunoglobulin-like receptors (LIR)"); 6,384,202 ("Cell-specific active compounds regulated by the cell cycle"); 6,384,018 ("Polynucleotide tuberculosis vaccine"); 6,383,814 ("Cationic amphiphiles for intracellular delivery of therapeutic molecules"); 6,383,811 ("Polyampholytes for delivering polyions to a cell"); 6,383,795 ("Efficient purification of adenovirus"); 6,383,794 ("Methods of producing high titer recombinant adeno-associated virus"); 6,383,785 ("Self-enhancing, pharmacologically controllable expression systems"); 6,383,753 ("Yeast mammalian regulators of cell proliferation"); 6,383,746 ("Functional promoter for CCR5"); 6,383,743 ("Method for serial analysis of gene expression"); 6,383,738 ("Herpes simplex virus ORF P is a repressor of viral protein synthesis"); 6,383,737 ("Human oxalyl-CoA Decarboxylase"); 6,383,733 ("Methods of screening for pharmacologically active compounds for the treatment of tumour diseases"); 6,383,522 ("Toxicity reduced composition containing an anti-neoplastic agent and a shark cartilage extract"); 6,383,512 ("Vesicular complexes and methods of making and using the same"); 6,383,481 ("Method for transplantation of hemopoietic stem cells"); 6,383,478 ("Polymeric encapsulation system promoting angiogenesis"); 6,383,138 ("Method for transdermal sampling of analytes"); 6,380,382 ("Gene encoding a protein having diagnostic, preventive, therapeutic, and other uses"); 6,380,371 ("Endoglycan: a novel protein having selectin ligand and chemokine presentation activity"); 6,380,369 ("Human DNA mismatch repair proteins"); 6,380,362 ("Polynucleotides, polypeptides expressed by the polynucleotides and methods for their use"); 6,380,170 ("Nucleic acid construct for the cell cycle regulated expression of structural genes"); 6,380,169 ("Metal complex containing oligonucleoside cleavage compounds and therapies"); 6,379,967 ("Herpesvirus saimiri as viral vector"); 6,379,966 ("Intravascular delivery of non-viral nucleic acid protease proteins, and uses thereof").

Typically, for example, expression constructs are derived from plasmid vectors. One preferred construct is a modified pNASS vector (Clontech, Palo Alto, Calif.), which has nucleic acid sequences encoding an ampicillin resistance gene, a polyadenylation signal and a T7 promoter site. Other suitable mammalian expression vectors are well known (see, e.g., Ausubel et al., 1995; Sambrook et al., supra; see also, e.g., catalogues from Invitrogen, San Diego, Calif.; Novagen, Madison, Wis.; Pharmacia, Piscataway, N.J.; and others). Presently preferred constructs may be prepared that include a dihydrofolate reductase (DHFR) encoding sequence under suitable regulatory control, for promoting enhanced production levels of the binding domain-immunoglobulin fusion protei, which levels result from gene amplification following application of an appropriate selection agent (e.g., methetrexate).

Generally, recombinant expression vectors will include origins of replication and selectable markers permitting transformation of the host cell, and a promoter derived from a highly-expressed gene to direct transcription of a downstream structural sequence, as described above. The heterologous structural sequence is assembled in appropriate phase with translation initiation and termination sequences. Thus, for example, the binding domain-immunoglobulin fusion protein encoding nucleic acids as provided herein may be included in any one of a variety of expression vector constructs as a recombinant expression construct for expressing a binding domain-immunoglobulin fusion polypeptide in a host cell. In certain preferred embodiments the constructs are included in formulations that are administered in vivo. Such vectors and constructs include chromosomal, nonchromosomal and synthetic DNA sequences, e.g., derivatives of SV40; bacterial plasmids; phage DNA; yeast plasmids; vectors derived from combinations of plasmids and phage DNA, viral DNA, such as vaccinia, adenovirus, fowl pox virus, and pseudorabies, or replication deficient retroviruses as described below. However, any other vector may be used for preparation of a recombinant expression construct, and in preferred embodiments such a vector will be replicable and viable in the host.

The appropriate DNA sequence(s) may be inserted into a vector, for example, by a variety of procedures. In general, a DNA sequence is inserted into an appropriate restriction endonuclease site(s) by procedures known in the art. Standard techniques for cloning, DNA isolation, amplification and purification, for enzymatic reactions involving DNA ligase, DNA polymerase, restriction endonucleases and the like, and various separation techniques are those known and commonly employed by those skilled in the art. A number of standard techniques are described, for example, in Ausubel et al. (1993 *Current Protocols in Molecular Biology*, Greene Publ. Assoc. Inc. & John Wiley & Sons, Inc., Boston, Mass.); Sambrook et al. (1989 *Molecular Cloning*, Second Ed., Cold Spring Harbor Laboratory, Plainview, N.Y.); Maniatis et al. (1982 Molecular Cloning, Cold Spring Harbor Laboratory, Plainview, N.Y.); Glover (Ed.) (1985 *DNA Cloning Vol. I and II*, IRL Press, Oxford, UK); Hames and Higgins (Eds.), (1985 *Nucleic Acid Hybridization*, IRL Press, Oxford, UK); and elsewhere.

The DNA sequence in the expression vector is operatively linked to at least one appropriate expression control sequence(s) (e.g., a constitutive promoter or a regulated promoter) to direct mRNA synthesis. Representative examples of such expression control sequences include promoters of eukaryotic cells or their viruses, as described above. Promoter regions can be selected from any desired gene using CAT (chloramphenicol transferase) vectors or other vectors with selectable markers. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art, and preparation of certain particularly preferred recombinant expression constructs comprising at least one promoter or regulated promoter operably linked to a nucleic acid encoding an binding domain-immunoglobulin fusion polypeptide is described herein.

Transcription of the DNA encoding proteins and polypeptides included within the present invention by higher eukaryotes may be increased by inserting an enhancer sequence into the vector. Enhancers are cis-acting elements of DNA, usually about from 10 to 300 by that act on a promoter to increase its transcription. Examples including the SV40 enhancer on the late side of the replication origin by 100 to 270, a cytomegalovirus early promoter enhancer, the polyoma enhancer on the late side of the replication origin, and adenovirus enhancers.

Gene therapy is the use of genetic material to treat disease. It comprises strategies to replace defective genes or add new genes to cells and/or tissues, and is being developed for application in the treatment of cancer, the correction of metabolic disorders and in the field of immunotherapy. Gene therapies of the invention include the use of various constructs of the invention, with or without a separate carrier or delivery vehicle or constructs, for treatment of the diseases, disorders, and/or conditions noted herein. Such constructs may also be used as vaccines for treatment or prevention of the diseases, disorders, and/or conditions noted herein. DNA vaccines, for example, make use of polynucleotides encoding immunogenic protein and nucleic acid determinants to stimulate the immune system against pathogens or tumor cells. Such strategies can stimulate either acquired or innate immunity or can involve the modification of immune function through cytokine expression. In vivo gene therapy involves the direct injection of genetic material into a patient or animal model of human disease. Vaccines and immune modulation are systemic therapies. With tissue-specific in vivo therapies, such as those that aim to treat cancer, localized gene delivery and/or expression/targeting systems are preferred. Diverse gene therapy vectors have been designed to target specific tissues, and procedures have been developed to physically target specific tissues, for example, using catheter-based technologies, all of which are contemplated herein. Ex vivo approaches to gene therapy are also contemplated herein and involve the removal, genetic modification, expansion and re-administration of a patient's own cells. Examples include bone marrow transplantation for cancer treatment or the genetic modivation of lymphoid progenitor cells. Ex vivo gene therapy is preferably applied to the treatment of cells that are easily accessible and can survive in culture during the gene transfer process (such as blood or skin cells).

Useful gene therapy vectors include adenoviral vectors, lentiviral vectors, Adeno-associated virus (AAV) vectors, Herpes Simplex Virus (Hsv) vectors, and retroviral vectors.

Gene therapies may also be carried out using "naked DNA," lipsome-based delivery, lipid-based delivery (including DNA attached to positively charged lipids), and electroporation.

As provided herein, in certain embodiments, including but not limited to gene therapy embodiments, the vector may be a viral vector such as, for example, a retroviral vector. Miller et al., 1989 *BioTechniques* 7:980; Coffin and Varmus, 1996 Retroviruses, Cold Spring Harbor Laboratory Press, NY. For example, retroviruses from which the retroviral plasmid vectors may be derived include, but are not limited to, Moloney Murine Leukemia Virus, spleen necrosis virus, retroviruses such as Rous Sarcoma Virus, Harvey Sarcoma virus, avian leukosis virus, gibbon ape leukemia virus, human immunodeficiency virus, adenovirus, Myeloproliferative Sarcoma Virus, and mammary tumor virus.

Retroviruses are RNA viruses that can replicate and integrate into the genome of a host cell via a DNA intermediate. This DNA intermediate, or provirus, may be stably integrated into the host cell DNA. According to certain embodiments of the present invention, an expression construct may comprise a retrovirus into which a foreign gene that encodes a foreign protein is incorporated in place of normal retroviral RNA. When retroviral RNA enters a host cell coincident with infection, the foreign gene is also introduced into the cell, and may then be integrated into host cell DNA as if it were part of the retroviral genome. Expression of this foreign gene within the host results in expression of the foreign protein.

Most retroviral vector systems that have been developed for gene therapy are based on murine retroviruses. Such retroviruses exist in two forms, as free viral particles referred to as virions, or as proviruses integrated into host cell DNA. The virion form of the virus contains the structural and enzymatic proteins of the retrovirus (including the enzyme reverse transcriptase), two RNA copies of the viral genome, and portions of the source cell plasma membrane containing viral envelope glycoprotein. The retroviral genome is organized into four main regions: the Long Terminal Repeat (LTR), which contains cis-acting elements necessary for the initiation and termination of transcription and is situated both 5' and 3' of the coding genes, and the three coding genes gag, pol, and env. These three genes gag, pol, and env encode, respectively, internal viral structures, enzymatic proteins (such as integrase), and the envelope glycoprotein (designated gp70 and p15e) which confers infectivity and host range specificity of the virus, as well as the "R" peptide of undetermined function.

Separate packaging cell lines and vector producing cell lines have been developed because of safety concerns regarding the uses of retroviruses, including their use in expression constructs as provided by the present invention. Briefly, this methodology employs the use of two components, a retroviral vector and a packaging cell line (PCL). The retroviral vector contains long terminal repeats (LTRs), the foreign DNA to be transferred and a packaging sequence (y). This retroviral vector will not reproduce by itself because the genes that encode structural and envelope proteins are not included within the vector genome. The PCL contains genes encoding the gag, pol, and env proteins, but does not contain the packaging signal "y". Thus, a PCL can only form empty virion particles by itself. Within this general method, the retroviral vector is introduced into the PCL, thereby creating a vector-producing cell line (VCL). This VCL manufactures virion particles containing only the retroviral vector's (foreign) genome, and therefore has previously been considered to be a safe retrovirus vector for therapeutic use.

"Retroviral vector construct" refers to an assembly that is, within preferred embodiments of the invention, capable of directing the expression of a sequence(s) or gene(s) of interest, such as binding domain-immunoglobulin fusion encoding nucleic acid sequences. Briefly, the retroviral vector construct must include a 5' LTR, a tRNA binding site, a packaging signal, an origin of second strand DNA synthesis and a 3' LTR. A wide variety of heterologous sequences may be included within the vector construct, including for example, sequences which encode a protein (e.g., cytotoxic protein, disease-associated antigen, immune accessory molecule, or replacement gene), or which are useful as a molecule itself (e.g., as a ribozyme or antisense sequence).

Retroviral vector constructs of the present invention may be readily constructed from a wide variety of retroviruses, including for example, B, C, and D type retroviruses as well as spumaviruses and lentiviruses (see, e.g., RNA Tumor Viruses, Second Edition, Cold Spring Harbor Laboratory, 1985). Such retroviruses may be readily obtained from depositories or collections such as the American Type Culture Collection ("ATCC"; Rockville, Md.), or isolated from known sources using commonly available techniques. Any of the above retroviruses may be readily utilized in order to assemble or construct retroviral vector constructs, packaging cells, or producer cells of the present invention given the disclosure provided herein, and standard recombinant techniques (e.g., Sambrook et al, *Molecular Cloning: A Laboratory Manual*, 2d ed., Cold Spring Harbor Laboratory Press, 1989; Kunkle, 1985 *PNAS* 82:488).

Suitable promoters for use in viral vectors generally may include, but are not limited to, the retroviral LTR; the SV40 promoter; and the human cytomegalovirus (CMV) promoter described in Miller, et al., 1989 *Biotechniques* 7:980-990, or any other promoter (e.g., cellular promoters such as eukaryotic cellular promoters including, but not limited to, the histone, pol III, and β-actin promoters). Other viral promoters that may be employed include, but are not limited to, adenovirus promoters, thymidine kinase (TK) promoters, and B19 parvovirus promoters. The selection of a suitable promoter will be apparent to those skilled in the art from the teachings contained herein, and may be from among either regulated promoters or promoters as described above.

As described above, the retroviral plasmid vector is employed to transduce packaging cell lines to form producer cell lines. Examples of packaging cells which may be transfected include, but are not limited to, the PE501, PA317, ψ-2, ψ-AM, PA12, T19-14X, VT-19-17-H2, ψCRE, ψCRIP, GP+E-86, GP+envAm12, and DAN cell lines as described in Miller, *Human Gene Therapy*, 1:5-14 (1990). The vector may transduce the packaging cells through any means known in the art. Such means include, but are not limited to, electroporation, the use of liposomes, and $CaPO_4$ precipitation. In one alternative, the retroviral plasmid vector may be encapsulated into a liposome, or coupled to a lipid, and then administered to a host.

The producer cell line generates infectious retroviral vector particles that include the nucleic acid sequence(s) encoding the binding domain-immunoglobulin fusion polypeptides or fusion proteins. Such retroviral vector particles then may be employed, to transduce eukaryotic cells, either in vitro or in vivo. The transduced eukaryotic cells will express the nucleic acid sequence(s) encoding the binding domain-immunoglobulin fusion polypeptide or fusion protein. Eukaryotic cells which may be transduced include, but are not limited to, embryonic stem cells, as well as hematopoietic stem cells, hepatocytes, fibroblasts, circulating peripheral blood mononuclear and polymorphonuclear cells including myelomonocytic cells, lymphocytes, myoblasts, tissue macrophages, dendritic cells, Kupffer cells, lymphoid and reticuloendothelia cells of the lymph nodes and spleen, keratinocytes, endothelial cells, and bronchial epithelial cells.

As another example of an embodiment of the invention in which a viral vector is used to prepare, for example, a recombinant binding domain-immunoglobulin fusion expression construct, in one preferred embodiment, host cells transduced by a recombinant viral construct directing the expression of binding domain-immunoglobulin fusion polypeptides or fusion proteins may produce viral particles containing expressed binding domain-immunoglobulin fusion polypeptides or fusion proteins that are derived from portions of a host cell membrane incorporated by the viral particles during viral budding.

In another aspect, the present invention relates to host cells containing the herein described nucleic acid constructs, such as, for example, recombinant binding domain-immunoglobulin fusion expression constructs. Host cells are genetically engineered (transduced, transformed or transfected) with the vectors and/or expression constructs of this invention that may be, for example, a cloning vector, a shuttle vector, or an expression construct. The vector or construct may be, for example, in the form of a plasmid, a viral particle, a phage, etc. The engineered host cells can be cultured in conventional nutrient media modified as appropriate for activating promoters, selecting transformants or amplifying particular genes such as genes encoding binding domain-immunoglobulin fusion polypeptides or binding domain-immunoglobulin fusion fusion proteins. The culture conditions for particular host cells selected for expression, such as temperature, pH and the like, will be readily apparent to the ordinarily skilled artisan.

The host cell for production or expression of a construct of the invention, for example, can be a higher eukaryotic cell, such as a mammalian cell, or a lower eukaryotic cell, such as a yeast cell, or the host cell can be a prokaryotic cell, such as a bacterial cell. Representative examples of appropriate host cells according to the present invention include, but need not be limited to, bacterial cells, such as *E. coli, Streptomyces, Salmonella typhimurium*; fungal cells, such as yeast; insect cells, such as *Drosophila* S2 and *Spodoptera* Sf9; animal cells, such as CHO, COS or 293 cells; adenoviruses; plant cells, or any suitable cell already adapted to in vitro propagation or so established de novo. The selection of an appropriate host is deemed to be within the scope of those skilled in the art from the teachings herein.

Various mammalian cell culture systems can also be employed to express recombinant protein. Examples of mammalian expression systems include the COS-7 lines of monkey kidney fibroblasts, described by Gluzman, 1981 *Cell* 23:175, and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences, for example as described herein regarding the preparation of binding domain-immunoglobulin fusion expression constructs. DNA sequences derived from the SV40 splice, and polyadenylation sites may be used to provide the required nontranscribed genetic elements. Introduction of the construct into the host cell can be effected by a variety of methods with which those skilled in the art will be familiar, including but not limited to, for example, calcium phosphate transfection, DEAE-Dextran mediated transfection, or electroporation (Davis et al., 1986 *Basic Methods in Molecular Biology*).

The present invention constructs, for example, binding domain-immunoglobulin fusion proteins, or compositions comprising one or more polynucleotides encoding same as described herein (for example, to be administered under conditions and for a time sufficient to permit expression of a binding domain-immunoglobulin fusion protein in a host cell in vivo or in vitro, for gene therapy, for example, among other things), may be formulated into pharmaceutical compositions for administration according to well known methodologies. Pharmaceutical compositions generally comprise one or more recombinant expression constructs, and/or expression products of such constructs, in combination with a pharmaceutically acceptable carrier, excipient or diluent. Such carriers will be nontoxic to recipients at the dosages and concentrations employed. For nucleic acid-based formulations, or for formulations comprising expression products of the subject invention recombinant constructs, about 0.01 µg/kg to about 100 mg/kg body weight will be adminstered, for example, typically by the intradermal, subcutaneous, intramuscular or intravenous route, or by other routes. A preferred dosage, for example, is about 1 µg/kg to about 1 mg/kg, with about 5 µg/kg to about 200 µg/kg particularly preferred. It will be evident to those skilled in the art that the number and frequency of administration will be dependent upon the response of the host. "Pharmaceutically acceptable carriers" for therapeutic use are well known in the pharmaceutical art, and are described, for example, in *Remingtons Pharmaceutical Sciences*, Mack Publishing Co. (A. R. Gennaro edit. 1985). For example, sterile saline and phosphate-buffered saline at physiological pH may be used. Preservatives, stabilizers, dyes and even flavoring agents may be provided in the pharmaceutical composition. For example, sodium benzoate, sorbic acid and esters of p-hydroxybenzoic acid may be added as preservatives. Id. at 1449. In addition, antioxidants and suspending agents may be used. Id.

"Pharmaceutically acceptable salt" refers to salts of the compounds of the present invention derived from the combination of such compounds and an organic or inorganic acid (acid addition salts) or an organic or inorganic base (base addition salts). The compounds of the present invention may be used in either the free base or salt forms, with both forms being considered as being within the scope of the present invention.

The pharmaceutical compositions that contain one or more nucleic acid constructs of the invention, for example, binding domain-immunoglobulin fusion protein encoding constructs (or their expressed products) may be in any form that allows for the composition to be administered to a patient. For example, the composition may be in the form of a solid, liquid or gas (aerosol). Typical routes of administration include, without limitation, oral, topical, parenteral (e.g., sublingually or buccally), sublingual, rectal, vaginal, and intranasal. The term parenteral as used herein includes subcutaneous injections, intravenous, intramuscular, intrasternal, intracavernous, intrathecal, intrameatal, intraurethral injection or infusion techniques. The pharmaceutical composition is formulated so as to allow the active ingredients contained therein to be bioavailable upon administration of the composition to a patient. Compositions that will be administered to a patient take the form of one or more dosage units, where for example, a tablet may be a single dosage unit, and a container of one or more compounds of the invention in aerosol form may hold a plurality of dosage units.

For oral administration, an excipient and/or binder may be present. Examples are sucrose, kaolin, glycerin, starch dextrins, sodium alginate, carboxymethylcellulose and ethyl cellulose. Coloring and/or flavoring agents may be present. A coating shell may be employed.

The composition may be in the form of a liquid, e.g., an elixir, syrup, solution, emulsion or suspension. The liquid may be for oral administration or for delivery by injection, as two examples. When intended for oral administration, preferred compositions contain, in addition to one or more binding domain-immunoglobulin fusion construct or expressed product, one or more of a sweetening agent, preservatives, dye/colorant and flavor enhancer. In a composition to be administered by injection, one or more of a surfactant, preservative, wetting agent, dispersing agent, suspending agent, buffer, stabilizer and isotonic agent, for example, may be included.

A liquid pharmaceutical composition as used herein, whether in the form of a solution, suspension or other like form, may include one or more of the following adjuvants: sterile diluents such as water for injection, saline solution, preferably physiological saline, Ringer's solution, isotonic sodium chloride, fixed oils such as synthetic mono or digylcerides which may serve as the solvent or suspending medium, polyethylene glycols, glycerin, propylene glycol or other solvents; antibacterial agents such as benzyl alcohol or methyl paraben; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. The parenteral preparation can be enclosed in ampoules, disposable syringes or multiple dose vials made of glass or plastic. Physiological saline is a preferred adjuvant. An injectable pharmaceutical composition is preferably sterile.

It may also be desirable to include other components in the preparation, such as delivery vehicles including but not limited to aluminum salts, water-in-oil emulsions, biodegradable oil vehicles, oil-in-water emulsions, biodegradable microcapsules, and liposomes. Examples of immunostimulatory substances (adjuvants) for use in such vehicles include N-acetylmuramyl-L-alanine-D-isoglutamine (MDP), lipopoly-saccharides (LPS), glucan, IL-12, GM-CSF, gamma interferon and IL-15.

While any suitable carrier known to those of ordinary skill in the art may be employed in the pharmaceutical compositions of this invention, the type of carrier will vary depending on the mode of administration and whether a sustained release is desired. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactic galactide) may also be employed as carriers for the pharmaceutical compositions of this invention. Suitable biodegradable microspheres are disclosed, for example, in U.S. Pat. Nos. 4,897,268 and 5,075,109. In this regard, it is preferable that the microsphere be larger than approximately 25 microns.

Pharmaceutical compositions may also contain diluents such as buffers, antioxidants such as ascorbic acid, low molecular weight (less than about 10 residues) polypeptides, proteins, amino acids, carbohydrates including glucose, sucrose or dextrins, chelating agents such as EDTA, glutathione and other stabilizers and excipients. Neutral buffered saline or saline mixed with nonspecific serum albumin are exemplary appropriate diluents. Preferably, product is formulated as a lyophilizate using appropriate excipient solutions (e.g., sucrose) as diluents.

As described above, the subject invention includes compositions capable of delivering nucleic acid molecules encoding binding domain-immunoglobulin fusion proteins. Such compositions include recombinant viral vectors (e.g., retroviruses (see WO 90/07936, WO 91/02805, WO 93/25234, WO 93/25698, and WO 94/03622), adenovirus (see Berkner, 1988 Biotechniques 6:616-627; L1 et al., 1993 Hum. Gene Ther. 4:403-409; Vincent et al., Nat. Genet. 5:130-134; and Kolls et al., 1994 Proc. Natl. Acad. Sci. USA 91:215-219), pox virus (see U.S. Pat. No. 4,769,330; U.S. Pat. No. 5,017,487; and WO 89/01973)), recombinant expression construct nucleic acid molecules complexed to a polycationic molecule (see WO 93/03709), and nucleic acids associated with liposomes (see Wang et al., 1987 Proc. Natl. Acad. Sci. USA 84:7851). In certain embodiments, the DNA may be linked to killed or inactivated adenovirus (see Curiel et al., 1992 Hum. Gene Ther. 3:147-154; Cotton et al., 1992 Proc. Natl. Acad. Sci. USA 89:6094). Other suitable compositions include DNA-ligand (see Wu et al., 1989 J. Biol. Chem. 264:16985-16987) and lipid-DNA combinations (see Felgner et al., 1989 Proc. Natl. Acad. Sci. USA 84:7413-7417).

In addition to direct in vivo procedures, ex vivo procedures may be used in which cells are removed from a host, modified, and placed into the same or another host animal. It will be evident that one can utilize any of the compositions noted above for introduction of constructs of the invention, for example, binding domain-immunoglobulin fusion proteins or of binding domain-immunoglobulin fusion protein encoding nucleic acid molecules into tissue cells in an ex vivo context. Protocols for viral, physical and chemical methods of uptake are well known in the art.

Accordingly, the present invention is useful for treating a patient having a B cell disorder or a malignant condition, or for treating a cell culture derived from such a patient. As used herein, the term "patient" refers to any warm-blooded animal, preferably a human. A patient may be afflicted with cancer or a malignant condition, such as B cell lymphoma, or may be normal (i.e., free of detectable disease and infection). A "cell culture" includes any preparation amenable to ex vivo treatment, for example a preparation containing immunocompetent cells or isolated cells of the immune system (including, but not limited to, T cells, macrophages, monocytes, B cells and dendritic cells). Such cells may be isolated by any of a variety of techniques well known to those of ordinary skill in the art (e.g., Ficoll-hypaque density centrifugation). The cells may (but need not) have been isolated from a patient afflicted with a B cell disorder or a malignant condition, and may be reintroduced into a patient after treatment.

A liquid composition intended for either parenteral or oral administration should contain an amount of a construct of the invention, for example, a binding domain-immunoglobulin fusion protein encoding construct or expressed product, such that a suitable dosage will be obtained. Typically, this amount is at least 0.01 wt % of a binding domain-immunoglobulin fusion construct or expressed product in the composition. When intended for oral administration, this amount may be varied to be between 0.1 and about 70% of the weight of the composition. Preferred oral compositions contain between about 4% and about 50% of binding domain-immunoglobulin fusion construct or expressed product(s). Preferred compositions and preparations are prepared so that, for example, a parenteral dosage unit contains between 0.01 to 1% by weight of active compound.

The pharmaceutical composition may be intended for topical administration, in which case the carrier may suitably comprise a solution, emulsion, ointment, or gel base. The base, for example, may comprise one or more of the following: petrolatum, lanolin, polyethylene glycols, beeswax, mineral oil, diluents such as water and alcohol, and emulsifiers and stabilizers. Thickening agents may be present in a pharmaceutical composition for topical administration. If intended for transdermal administration, the composition may include a transdermal patch or iontophoresis device. Topical formulations may contain a concentration of a construct of the invention, for example, a binding domain-immunoglobulin fusion construct or expressed product, of from about 0.1 to about 10% w/v (weight per unit volume).

The composition may be intended for rectal administration, in the form, e.g., of a suppository that will melt in the rectum and release the drug. The composition for rectal administration may contain an oleaginous base as a suitable nonirritating excipient. Such bases include, without limitation, lanolin, cocoa butter and polyethylene glycol.

In the methods of the invention, a construct of the invention, for example, a binding domain-immunoglobulin fusion encoding constructs or expressed product(s), may be administered through use of insert(s), bead(s), timed-release formulation(s), patch(es) or fast-release formulation(s).

Constructs of the invention, for example, antigen-binding constructs of the invention, may be administered or co-administered to an animal or patient in combination with, or at the same or about the same time, as other compounds. In one aspect, one or more constructs, including for example one or more antigen-binding constructs, are administered to an animal or patient in conjunction with one or more chemotheraputic compounds such as alkylating agents, nucleoside analogues, and the like. The administration or co-administration of one or more constructs, including one or more antigen-binding constructs, of the invention and one or more chemotheraputic agents can be used for the treatment of tumors or cancer in an animal or patient. Exemplary cancers include, but are not limited to, head and neck cancer, breast cancer, colorectal cancer, gastric cancer, hepatic cancer, bladder cancer, cervical cancer, endometrial cancer, lung cancer (non-small cell), ovarian cancer, pancreatic cancer, prostate cancer; choriocarcinoma (lung cancer); hairy cell leukemia, chronic lymphotic leukemia, acute lymphocytic leukemia (breast & bladder), acute myelogenous leukemia, meningeal leukemia, chronic myelogenous leukemia, erythroleukemia. More commonly the cancers treated include non-Hodgkin's lymphoma (osteogenic sarcoma, adult soft tissue sarcoma), T-cell lymphoma, chronic lymphocytic leukaemia, slowly growing non-Hodgkin's lymphomas, Hodgkin's lymphoma and ovarian cancer.

Examples of an alkylating agents that can be co-administered with one or more constructs, including one or more antigen-binding constructs, of the invention include mechlorethamine, chlorambucil, ifosfamide, melphalan, busulfan, carmustine, lomustine, procarbazine, dacardazine, cisplatin, carboplatin, mitomycin C, cyclophosphamide, ifosfamide, thiotepa, and dacarbazine, and analogues thereof. See for example U.S. Pat. No. 3,046,301 describing the synthesis of chlorambucil, U.S. Pat. No. 3,732,340 describing the synthesis of ifosfamide, U.S. Pat. No. 3,018,302 for the synthesis of cyclophosphamide, U.S. Pat. No. 3,032,584 describing the synthesis of melphalan, and Braunwald et al., "Harrison's Principles of Internal Medicine," 15th Ed., McGraw-Hill, New York, N.Y., pp. 536-544 (2001) for clinical aspects of cyclophosphamide, chlorambucil, melphalan, ifosfamide, procarbazine, hexamethylmelamine, cisplatin, and carboplatin. Examples of nucleoside analogues, include, but are not limited to, fludarabine pentostatin, methotrexate, fluorouracil, fluorodeoxyuridine, CB3717, azacitidine, cytarabine, floxuridine, mercaptopurine, 6-thioguanine, cladribine, and analogues thereof. One example is the combination of constructs, including antigen-binding constructs that bind CD20. This construct acts as a chemosensitising agent and works together with chemotherapeutic agents, such that less chemotherapeutic agents are necessary to achieve anti-tumor or anti-cancer effects. For example, U.S. Pat. No. 3,923,785 describing the synthesis of pentostatin, U.S. Pat. No. 4,080,325 describing the synthesis of methotrexate, U.S. Pat. No. 2,802,005 describing the synthesis of fluorouracil, and Braunwald et al., "Harrison's Principles of Internal Medicine," 15th Ed., McGraw-Hill, New York, N.Y., pp. 536-544 (2001) for clinical aspects of methotrexate, 5-fluorouracil, cytosine arabinoside, 6-mercaptopurine, 6-thioguanine, and fludarabine phosphate.

In another aspect, one or more constructs, including one or more antigen-binding constructs, of the invention can be administered or co-administered compounds that inhibit topoisomerase II or compounds that otherwise interact with nucleic acids in cells. Such compounds include, for example, doxorubicin, epirubicin, etoposide, teniposide, mitoxantrone, and analogues thereof. In one example, this combination is used in treatment to reduce tumor cell contamination of peripheral blood progenitor cells (PBSC) in conjunction with high-dose chemotherapy and autologous stem cell support (HDC-ASCT). See U.S. Pat. No. 6,586,428 to Geroni et al.

In anther aspect, one or more constructs, including one or more antigen-binding constructs, of the invention can be administered or co-adminstered with therapeutic drugs. For example, Virulizin (Lorus Therapeutics), which is believed to stimulate the release of tumour necrosis factor, TNF-alpha, by tumour cells in vitro and stilumalate activiation of macrophage cells. This can be used in combination with one or more constructs, including one or more antigen-binding constructs, of the invention to increase cancer cell apoptosis and treat various types of cancers including Pancreatic Cancer, Malignant Melanoma, Kaposi's Sarcoma (KS), Lung Cancer, Breast Cancer, Uterine, Ovarian and Cervical Cancer. Another example is CpG 7909 (Coley Pharmaceutical Group), which is believed to activate NK cells and monocytes and enhance ADCC. This drug can be used in combination with cancer or tumor specific constructs, including antigen-binding constructs, of the invention, such as an anti-CD20 construct, to treat non-Hodgkin's lymphoma and other cancers.

One or more constructs, including one or more antigen-binding constructs, of the invention can also be combined with angiogensis inhibitors to increase anti-tumor effects. Angiogenisis is the growth of new blood vessels. This process allows tumors to grow and metastasize. Inhibiting angiogeneisis can help prevent metastasis, and stop the spread of tumors cells. Angiogenisis inhibitors include, but are not limited to, angiostatin, endostatin, thrombospondin, platelet factor 4, Cartilage-derived inhibitor (CDI), retinoids, Interleukin-12, tissue inhibitor of metalloproteinase 1, 2 and 3 (TIMP-1, TIMP-2, and TIMP-3) and proteins that block the angiogensis signaling cascade, such as anti-VEGF (Vascular Endothelial Growth Factor) and IFN-alpha. Angiogenesis inhibitors can be administered or co-administered with tumor specific constructs, including antigen-binding constructs capable of mediating, for example, ADCC and/or complement fixation or chemotherapy-conjugated antigen-binding of the invention to combat various types of cancers, for example, solid tumor cancers such as lung and breast cancer.

In another aspect, one or more constructs, including one or more antigen-binding constructs, of the invention can be administered or co-administered with disease modifying anti-rheumatic agents (DMAR agents) for the treatment of rheumatoid arthritis, psoriasis, ulcerative colitus, systemic lupus erythematosus (SLE), Crohn's disease, ankylosing spondylitis, and various inflammatory disease processes. In such treatment, the constructs, for example, antigen-binding constructs, of the invention are commonly administered in conjunction with compounds such as azathioprine, cyclosporin, gold, hydroxychloroquine, methotrexate, penicallamine, sulphasalazine, and the like.

In another aspect, one or more constructs, including one or more antigen-binding constructs, of the invention can be administered or co-administered with agents or compounds that counteract the biological effects of interleukin-1, including for example interleukin-1 inhibitors and interleukin-1 receptor antagonist. It is thought that interleukin-1 has a role in the generation of rheumatoid arthritis (RA), inflammation, and the destruction of joints. IL-1 inhibitors can also be used in conjunction with the constructs, including antigen-binding constructs, of the invention to treat arthritis, inflammatory bowel disease, sepsis and septic shock, ischemic injury, reperfusion, ischemic brain injury such as cerebral palsy and multiple sclerosis. See U.S. Pat. No. 6,159,460 to Thompson et al. In another aspect, for example, one or more constructs, including one or more antigen-binding constructs, of the invention can be administered or co-administered to an animal or patient in conjunction with one or more glucocorticoids for example, methylprednisilone, dexamethasone, hydrocortisone, and the like. Glucocorticoids have been used to induce apoptosis and inhibit growth, independent of ADCC and CDC. These compounds can be combined with constructs, including antigen-binding constructs, of the invention capable of inducing apoptosis in cancer cells. In one example is the anti-CD20, and anti-CD40 antigen-binding constructs, which can be used to induce apoptosis in B-cells, are combined with glutcocorticoids to treat B-cell non-Hodgkin's lymphoma (NHL).

In another aspect, one or more constructs, including one or more antigen-binding constructs, of the invention can be administered or co-administered with p38 inhibitors or antagonists. The p38 mitogen-activated protein kinase pathway is involved in a number of cellular processes instrumental to the development of rheumatoid arthritis. For example, the activation and infiltration of leukocytes as well as the production of inflammatory cytokines are p38-dependent processes.

In another aspect, one or more constructs, including one or more antigen-binding constructs, of the invention are administered or co-administered with compounds that promote the differentiation and proliferation of B-cells. Cytokines such as \interleukin-4 (IL-4) and interleukin-6 (IL-6), in additional to other biological activities, have been shown to stimulate antibody synthesis and secretion by activated B lympocytes. In a particular aspect of the invention, constructs, including antigen-binding constructs that recognize and bind CD20 are co-administered with one or more of interleukin-4 (IL-4) and interleukin-6 (IL-6).

In another aspect one or more constructs, including one or more antigen-binding constructs, of the invention can be administered or co-administered with Interleukin-2 (IL-2). Interleukin 2 (IL-2) is a lymphokine that increases production of effector cells, such as CD4+ T-helper cells, CD8 cytotoxic cells, antibody producing B cells, natural killer cells (NK), and monocytes/macrophages. IL-2 helps produce T-cells, which in turn secrete more of the IL-2 (an "autocrine loop"). IL-2 can be used to augment antibody-dependent cell-mediated cytotoxicity (ADCC) and immunotherapies associated with constructs of the invention. In one example, an anti-CD20 construct of the invention and IL-2 are used to treat patients with relapsed or refractory follicular non-Hodgkin's lymphoma. In another example IL-2 is administered or co-administered with HIV immunotherapies to help with T cell recovery.

In another aspect one or more constructs, including one or more antigen-binding constructs, of the invention can be administered or co-administered with Interleukin-12 (IL-12). IL-12 is know to enhance cytolytic T-cell responses, promote the development of helper T cells, enhance the activity of natural killer (NK) cells, and induces the secretion of IFN-γ in T and NK cells. IL-12 also increases many helper and effector cells that mediate apoptosis. In another aspect of the invention, one or more constructs, including one or more antigen-binding constructs, are administered or co-administeredwith IL-12 in the treatment of an animal or patient with a tumor or cancer. For example, a construct, including an antigen-binding construct, of the invention that binds CD20 combined with IL-2 for thetreatment of a patient with B-cell non-Hodgkin's lymphoma (NHL).

One or more constructs, including one or more antigen-binding constructs, of the invention can also be combined with immunomodulators to boost the efficacy of the antigen-binding constructs of the invention. Immunomodulators include, but are not limited to, Colony Stimulating Factors (CSF), Tumor necrosis Factors (TNF), and Interferons (IFN).

CSFs can include granulocyte-macrophage CSF (GM-CSF), granulocyte-CSF (G-CSF), and macrophage CSF (M-CSF). GM-CSF is thought to regulate the development of neutrophils, macrophages, monocytes and eosinophils. G-CSF has been shown to induce neutrophil production, and M-CSF production. M-CSF has been shown to stimulate macrophages and monocytes. The use of CSFs to treat neutropenia in cancer patients has been long established. In one example, constructs, including antigen-binding constructs, of the invention can be combined with GM-CSF, G-CSF or combinations thereof in order to accelerate recovery from neutropenia in patients after bone marrow trans-plantation and chemotherapy. Neutrophils play a major role in fighting microbes such as bacterial, fungi and parasites. Patients with neutropenia are particularly susceptible to bacterial and wide spread fungal infections. In another example, a construct, including an antigen binding construct, of the invention can be combined with GM-CSF-treated neutrophils, monocytes and macrophages to increase activity against bacteria, fungi, etc, including the dreaded *Pneumocystis carinii*.

An example of an IFN is interferon alpha (IFN-α). IFN-α is made naturally by some types of white blood cell as part of the immune response when the body reacts to cancers or viral infections. It has two main modes of attack, interfering with growth and proliferation of cancer cells and it boosting the production of killer T cells and other cells that attack cancer cells. Interferon is also thought to facilitate cancer cells to put out chemical signals that make them better targets for the immune system, and has been used in recent years for several different types of cancer, particularly kidney cancer, melanoma, multiple myeloma, and some types of leukemia. It is also used to treat viral infections such as hepatitis. Interferon-alpha2a, for example, enhances ADCC and can be combined with one or more constructs, including antigen-binding constructs, of the invention to increase the efficiency of ADCC activity associated with the construct. In another example, one or more constructs, including one or more antigen-binding constructs of the invention are administered or co-administered to an animal or patient with interferon-gamma (IFN-γ), which has been show to increase the number of anti-CD20 antigens on B cells and bone marrow plasma cells (BMPC). This is particularly useful for the treatment of patients with multiple myelomas, which have a reduced expression of CD20 in their B cells and bone marrow plasma cells (BMPC). Accordingly, the treatment of multiple myeloma patients with constructs, including antigen-binding constructs of the invention, in particular constructs that bind CD20, may be usefully co-administered in conjunction with IFN-γ TNF is a class of natural chemicals with anticancer properties. One example of a TNF is TNF-alpha. TNF-alpha has also been shown to have synergistic effects with IFN-gamma and IL-12. In another example, TNF can be administered or co-administered with one or more tumor specific constructs, including one or more antigen-binding constructs, of the invention, and include chemotherapy-conjugated antigen binding constructs of the invention, together with IFN-gamma, IL-12 or various combinations thereof. TNF is also known to be an inflammatory regulation molecule. TNF-alpha antibodies or antagonist(s) can be combined with anti-T cell constructs, including antigen-binding constructs, of the invention to treat patients with rheumatoid arthritis, psoriasis, ulcerative colitus, systemic lupus erythematosus (SLE), Crohn's disease, ankylosing spondylitis, and various inflammatory disease processes.

In another aspect, one or more constructs, including one or more antigen-binding constructs, of the invention can be administered or co-administered with another antibody or antigen-binding construct of the invention. One example is a construct, for example, an antigen-binding construct of the invention capable of binding CD20 combined with a construct capable of binding CD22, CD19 or combinations thereof. This combination is effective as a treatment for indolent and aggressive forms of B-cell lymphomas, and acute and chronic forms of lymphatic leukemias. See U.S. Pat. No. 6,306,393 to Goldberg. In another example, constructs, including antigen-binding constructs, of the invention are co-administered with other constructs such as antigen-binding constructs of the invention that aid in mediating apoptosis. For example, a combination of one or more constructs, including one or more antigen-binding constructs of the invention capable of binding CD28, CD3, CD20 or a combination thereof. The combination of anti-CD28 and CD3 provides a method for prolonged proliferation of T-cells. See U.S. Pat. No. 6,352,694 to June et al. This prolonged T-cell proliferation increases the efficiency immune dependent cytotoxicity, particularly those associated with anti-CD20.

In another aspect, constructs, including antigen-binding constructs, of the invention can be administered or co-administered with one or more T-cell regulatory molecules. One example is a combination with interleukin-12 (IL-12). The IL-12 cytokine stimulates cell-mediated immunity, has angiostatic activity, and possesses significant anti-tumor effects in a variety of tumor models. IL-12 has also been shown to stimulate the production of interferon-gamma (IFN-γ). Accordingly, the treatment of multiple myeloma patients with one or more constructs, including one or more antigen-binding constructs, of the invention, in particular those that bind CD20, is expected to be more efficacious when co-administered in conjunction with IL-12. In another example, one or more constructs, including one or more antigen-binding constructs, of the invention can be administered or co-administered with a binding-domain construct of the invention other protein capable of binding CTLA-4 to enhance the anti-tumor immune response, by inhibiting the downregulation of T-cell activation.

In another aspect, one or more constructs, including one or more antigen-binding constructs, of the invention can be combined with gene therapies. In one example, a chemotherapy-conjugated construct of the invention is administered or co-administered with the Bcl-2 antisense oligonucleotide. Bcl-2 is associated with tumor resistance to anti-cancer therapies, and its believed to blocking chemotherapy-induced cell death. In another example one or more constructs, including one or more antigen-binding constructs, of the invention is administered or co-administered with an adenovirus for delivery of a "suicide gene." The adenovirus inserts the gene directly into the tumor cells, which makes these cells sensitive to an otherwise ineffective drug. Drug treatment then destroys the tumor cells, while leaving healthy cells untouched. However, once therapy is complete stray cancer cells that escaped therapy can reestablish and metastasize. Combining gene therapy with one or more constructs, including one or more antigen-binding constructs, will help kill stray cancer cells and minimize cancer reoccurrence.

A similar combination can be used with palliative (non-radical) operations to surgically remove tumors. In this example one or more constructs, including one or more antigen-binding constructs, of the invention can be administered before and after surgical extractions of tumors in order to increase the immune response and reduce the likelihood of reoccurrence by killing any cancer cells that were not removed during the surgery.

Another aspect combines a cancer or antigen vaccine and T-cell regulator molecules. For example, the binding portion, for example, an antigen-binding portion, of a construct can be specific for a cancer cell or antigen, or a protein fragment from a cancer cell or antigen. This can help mediate an immune response against a particular tumor or antigen. Such constructs can be combined with T-cell regulators to increase the efficiency of the immune response.

In another example, one or more constructs, including one or more antigen-binding constructs, of the invention is administered or co-administered with retinoids. Retinoids include Vitamin A and its derivatives, which have the ability to stop cells from dividing and cause them to differentiate. Vitamin A is combined with an anti-cancer construct(s), including antigen-binding construct(s), of the invention to combat various forms of cancer.

The terms "binding construct" and "antigen-binding construct" as used herein may refer to, for example, engineered polypeptides, recombinant polypeptides, synthetic, semi-synthetic or other fusion proteins that are capable of binding a target, for example, an antigen. Antigen-binding constructs of the invention may be used in various applications, including those within the variety of uses to which antibodies or related immunoglobulin-type constructs may be put. Constructs, including antigen-binding constructs of the invention can be used in in vivo and in vitro experiments for therapeutic, diagnostic, research, and other purposes. Such uses include, for example, the following.

Constructs, including antigen-binding constructs of the invention may be used for immunohistochemistry applications. For example, they may be used for immunolocalization of a particular antigen or group of antigens in a tissue. Tissue can be fixed and incubated with antigen-binding constructs of interest. These constructs can then be localized using a secondary antibody or binding construct of the invention coupled to a label, for example, to a gold particle or an enzyme that gives a chemical reaction, like horseradish peroxidase or beta-galactosidase. A secondary antibody or binding construct is frequently made that is reactive against, for example, a portion of the primary binding construct. Thus, for example, if the primary binding construct has a human tail portion, the secondary antibody or binding construct could be, for example, a rabbit anti-mouse antibody or antigen-binding construct that has been linked to beta-galactosidase. Alternatively the antibody or binding construct of the invention can be purified and then conjugated to another molecule to produce a fluorescent antibody or binding construct.

Constructs, including antigen-binding contracts of the invention can also be used to detect the location of an antigen or antigens on the surface of cells or to detect the location of intracellular materials using, for example, Immunoelectron Microscopy. Electron dense materials such as ferritin or colloidal gold, for example, can be conjugated to an antigen-binding construct. Scanning electron microscopy can be used to detect the localization of the antigen/binding construct complex.

Constructs, including antigen-binding constructs of the invention may also be used to quantitate the presence of an antigen or antigens using one of a variety of immunoassay formats, for example, a radioimmunoassay (RIA) format or an enzyme-linked immunosorbent assay (ELISA) format. There are many variants of these approaches, but those are based on a similar idea. For example, if an antigen can be bound to a solid support or surface, or is in solution, it can be detected by reacting it with a specific antigen-binding construct of the invention. The presence or amount of the construct can then be detected or quantitated by reacting it with, for example, either a secondary antibody or a second antigen-binding construct of the invention by incorporating a label directly into the primary antibody. Alternatively, for example, an antigen-binding polypeptide of the invention can be bound to a solid surface and the antigen added. A second antibody or antigen-binding polypeptide(s) of the invention that recognizes a distinct epitope on the antigen can then be added and detected. This technique is commonly referred to as a "sandwich assay", which is frequently used to avoid problems of high background or non-specific reactions, among other reasons.

Because the binding constructs of the invention can have high affinity/affinities and/or selectivity/selectivities for a particular epitope or epitopes, they can also be used as affinity reagents, for example, in protein or antigen purification. In one example of such a process, antigen-binding constructs of the invention are immobilized on a suitable support, for example, Sephadex resin or filter paper. The immobilized construct is exposed to a sample containing, or suspected of containing, a target protein(s) or antigen(s). The support is rinsed with a suitable buffer that will remove unwanted materials. The support is washed with another buffer that will release the bound protein(s) or antigen(s).

Because particular binding constructs of the invention can bind to proteins or other antigens with high affinity and selectivity they can also be used as a criterion for the importance of a particular enzyme or other macromolecule in a particular reaction. If an antigen-binding construct of the invention can interfere with a reaction in a solution, this will indicate that the construct may be binding specifically to a protein or other antigenic material involved in that reaction.

Constructs, including antigen-binding constructs of the invention can also be used as receptor blockers or inhibitors or antagonists.

Constructs, including antigen-binding constructs of the invention can also be used in identifying and studying the function(s) of proteins. If an antigen-binding construct of the invention reacts with a specific protein, for example, that protein can subsequently be precipitated from solution, for example. Precipitation is typically performed by using a secondary antibody or antigen-binding construct of the invention that links primary complexes together. Alternatively, the complex can be removed by reacting the solution with either protein A or, for example, depending on the construct, an anti-Fc antibody, for example, which has been attached to beads, for example, so that can be easily removed form the solution.

Constructs, including antigen-binding constructs of the invention can also be used in conjunction with gel-shift experiments to identify specific nucleic acid-binding proteins such as DNA-binding proteins. For example, DNA-binding proteins can be assayed by their ability to bind with high affinity to a particular oligonucleotide. The mobility of an oligonucleotide associated with the protein is far different than the mobility of a free oligonucleotide and results in a gel migration pattern and signal that is commonly referred to as a gel shift. The addition of the construct to the binding assay can have either of two effects. If the construct binds to a region of a protein not involved in DNA binding it can result in a complex that has even a slower mobility and is detected as a greater shift in mobility (a super-shift). Alternatively, if the construct binds to a region of the protein involved in recognizing the DNA then it can disrupt the binding and eliminate the shift. In either case, the data from these experiments can serve as a criterion to identify a DNA-binding protein, for example.

It is also possible to use constructs, including antigen-binding constructs of the invention to detect a protein by western blotting after fractionation by SDS-PAGE, for example. Once fractionated proteins are transferred to a membrane such as a nitrocellulose sheet, they are exposed to a particular antigen-binding construct of the invention that specifically recognizes, or recognizes to a desired degree of selectivity, proteins immobilized to the blot. This allows particular proteins to be identified. This approach is particularly useful if the mobility of the protein changes during an experiment. For example, incorporation of a phosphate or a carbohydrate, or cleavage of the protein, results in a change in mobility that can be followed in straightforward manner by western analysis. With appropriate controls, this approach can be used to measure the abundance of a protein in response to experimental manipulations.

The combination of SDS gels and immunoprecipation can also be extremely effective. If a particular protein can be immunoprecipitated in a solution, both supernatant and precipitated fractions can be separated on an SDS gel and studied using an antigen-binding construct(s) of the invention.

Sometimes a binding construct of the invention directed against one protein will also precipitate a second protein that interacts with the first protein. The second protein, as well as the first, can then be seen by staining the gel or by autoradiography. This relationship is frequently the first indication that a protein functions as part of a complex and it can also be used to demonstrate a physical interaction of two proteins that are hypothesized to interact on the basis of other evidence (e.g., a two hybrid screen or a supressor mutation). This approach can be combined with western blotting analysis in several extremely effective ways.

Thus, for example, antigen-binding constructs of the invention can be used in a combination of immunoprecipitation and western analysis in the study, for example, of signal transduction and protein processing. For example, an immunoprecipitated protein can be subsequently studied by western analysis using a different antibody or antigen-binding construct of the invention that binds to the protein. The most useful of are those that are directed against particular structural determinants that may be present in a protein. Thus, an antibody or antigen-binding construct of the invention directed against a region of the protein that undergoes proteolytic processing can be useful to follow proteolytic processing. Additionally, a construct of the invention or a mixture of antigen-binding constructs of the invention that recognize phosphorylated peptides (e.g., anti PY (phosphorylated tyrosine) can be used to follow the extent of phosphorylation of a protein (using western analysis) after it is precipitated, or visa versa. Glycosylation reactions can also be followed by antigen-binding constructs of the invention directed against a carbohydrate epitope (or by lectins, i.e., proteins that recognize carbohydrates). Likewise, some antigen-binding constructs of the invention can be made that specifically recognize a phosphorylated epitope, for example, that will recognize a tyrosine or a serine residue after phosphorylation, but will not bind (or detectably bind) the epitope in the absence of phosphate. This approach can be used to determine the phosphorylation state of a particular protein. For example, the phosphorylation of CREB (the cAMP response element binding protein) can be followed by an antibody that specifically recognizes an epitope in a way that is dependent on the phosphorylation of serine 133.

Constructs, including antigen-binding constructs of the invention can also be used to screen expression libraries to isolate candidate polynucleotides that express or present a particular epitope, or that have a particular affinity or expression characteristic.

Constructs, including antigen-binding constructs of the invention that bind to a cell surface can also be used as a marker to quantitate the fraction of cells expressing that marker using flow cytometry. If different antigen binding constructs of the invention/fluorescent dye combinations are used, for example, the fraction of cells expressing several antigens can be determined.

Constructs, including antigen-binding constructs of the invention that function like anti-idiotype antibodies, i.e., antibodies against the binding domain of another antibody, can be used in any of a number of methods in which is would be desirable or useful to mimic the structure of an antigen. Such uses include, for example, uses as cancer vaccines (including antigen-binding constructs of the invention that incorporate a molecular adjuvant), as probes for receptors, as receptor agonists, as receptor antagonists, as receptor blockers or inhibitors, and so on.

In another aspect, constructs, including antigen-binding constructs of the invention may bispecific and thus capable of binding to two distinct epitopes, which may be present on the same or different cell types.

In vivo uses of constructs of the invention, including antigen-binding constructs, include therapy, alone or in combination with one or more other therapies, for various diseases including cancers as well as B-cell disorders including autoimmune diseases. In some cases the constructs of the invention are administered to a patient. In other cases, the construct may be coupled to another molecule by techniques known in the art, for example, a fluorescent molecule to aid in imaging a target, or a therapeutic drug and/or a toxin to aid in killing a target.

For example, a labeling molecule or atom can be conjugated or otherwise linked to the antigen-binding construct of the invention to aid in imaging or as a diagnostic agent. These include, but are not limited to enzymatic labels, radioisotopes or radioactive compounds or elements, fluorescent compounds or metals, chemiluminescent compounds and biluminescent compounds. Thus, binding contructs or antigen-binding constructs of the invention can be conjugated to a drug, which allows specific drug targeting and increased efficiency once the drug reaches the target. This facilitates drug therapy while reducing systemic toxicity and side effects. This allows use of drugs that would otherwise be unacceptable when administered systemically. Dosage will depend on the potency of the drug and the efficiency of the carrier construct. Other examples of in vivo uses include the use of binding constructs or antigen-binding constructs of the invention in which a toxin is chemically linked or conjugated to an polypeptide of the invention to form, for example, molecules that may be termed "immunoconjugates" or "immunotoxins." Typically, for example, such a toxin may include one or more radioisotopes (for example, Iodine-131, Yttrium-90, Rhenium-186, Copper-67, and/or Bishmuth-212), natural toxins, chemotherapy agents, biological response modifiers, or any other substance that is capable of assisting in damaging or killing a target cell, inhibiting target cell replication, or is effective in disrupting a desired cellular function in a target cell.

The toxin portion of the immunotoxin can be derived form various sources. Toxins are commonly derived from plants or bacteria, but toxins of human origin or synthetic toxins can be used as well, for example. Examples of toxins derived from bacteria or plants include, but are not limited to, abrin, α-sarcin, diptheria toxin, ricin, saporin, and pseudomonas exotoxin. Examples of mammalian enzymes include, but are not limited to, ribonucleases (RNAse) and deoxyribonucleases. Numerous immunotoxins that may be used with one or more constructs of the invention have been described in the art. See, for example, U.S. Pat. No. 4,753,894 to Frankel et al.; U.S. Pat. No. 6,099,842 to Pastan et al.; Nevelle, et al., 1982 *Immunol Rev.* 62:75-91; Pastan et al., 1992 *Ann Rev Biochem* 61:331-354; Chaudary et al., 1989 *Nature* 339:394; and Batra et al., 1991 *Mol. Cell. Biol.* 11:2200. Modified toxins described herein and those described in the various publications are also within the scope of the instant invention.

Generally, the immunotoxins and other therapeutic agents of this invention are administered at a concentration that is therapeutically effective to treat or prevent a particular disease, disorder, or condition, such as for the treatment of tumors and malignancies, the treatment of autoimmune diseases, allergies and inflammation, etc. This effective dosage and mode of administration will depend on the animal or patient being treated, the disease or condition being treated, the strength of the immunoconjugates or immunotoxins and the efficiency of the conjugate. To accomplish this goal, the immunotoxins may be formulated using a variety of acceptable formulations and excipients known in the art. Typically, for example, the immunotoxins are administered by injection, either intravenously or intraperitoneally. Methods to accomplish this administration are known to those of ordinary skill in the art. It another aspect, the invention includes topically or orally administered compositions such as an aerosol or cream or patch that may be capable of transmission across mucous membranes.

Formulants may be added to an immunoconjugates or immunotoxins of the invention before administration to a patients being treated. A liquid formulation is most common, but other formulations are within the scope of the invention. The formulants may include for example oils, polymers, vitamins, carbohydrates, amino acids, salts, buffers, albumin, surfactants, or bulking agents. Carbohydrates can include sugar or sugar alcohols such as mono, di, or polysaccharides, or water-soluble glucans. The saccharides or glucans can include for example fructose, dextrose, lactose, glucose, mannose, sorbose, xylose, maltose, sucrose, dextran, pullulan, dextrin, alpha and beta cyclodextrin, soluble starch, hydroxethyl starch and carboxymethylcellulose, or mixtures thereof "Sugar alcohol" may be defined as a $C_4$ to $C_8$ hydrocarbon having an —OH group and includes, for example, galactitol, inositol, mannitol, xylitol, sorbitol, glycerol, and arabitol. These sugars or sugar alcohols mentioned above may be used individually or in combination. There is no fixed limit to the amount used as long as the sugar or sugar alcohol is soluble in the aqueous preparation. In one aspect, the sugar or sugar alcohol concentration is between 0.5 w/v % and 15 w/v %, typically between 1.0 w/v % and 7.0 w/v %, more typically between 2.0 and 6.0 w/v %.

Exemplary amino acids include levorotary (L) forms of carnitine, arginine, and betaine; however, other amino acids may be added. Commonly used polymers include polyvinylpyrrolidone (PVP) with an average molecular weight between 2,000 and 3,000, for example, or polyethylene glycol (PEG) with an average molecular weight between 3,000 and 5,000, for example. A buffer can be used in the composition to minimize pH changes in the solution before lyophilization or after reconstitution. Any physiological buffer may be used, but citrate, phosphate, succinate, and glutamate buffers or mixtures thereof are more commonly utilized. The concentration can be, for example, from 0.01 to 0.3 molar. Higher or lower concentrations may be used.

Immunotoxins of the invention can be chemically modified by covalent conjugation to a polymer to increase their circulating half-life, for example. Exemplary polymers and methods to attach them to peptides are referenced in U.S. Pat. Nos. 4,766,106 to Katre et al.; 4,179,337 to Davis et al.; 4,495,285 to Shimizu et al.; and 4,609,546 to Hiratani.

The following Examples are offered by way of illustration and not by way of limitation.

Example 1

Cloning of the 2H7 Variable Regions and Construction and Sequencing of 2H7scFv-Ig This Example illustrates the cloning of cDNA molecules that encode the heavy chain and light chain variable regions of the monoclonal antibody 2H7. This Example also demonstrates the construction, sequencing, and expression of 2H7scFv-Ig.

Prior to harvesting, cells expressing 2H7 monoclonal antibody that specifically bound to CD20 were kept in log phase growth for several days in RPMI 1640 media Invitrogen/Life Technologies, Gaithersburg, Md.) supplemented with glutamine, pyruvate, DMEM non-essential amino acids, and penicillin-streptomycin. Cells were pelleted by centrifugation from the culture medium, and $2 \times 10^7$ cells were used to prepare RNA. RNA was isolated from the 2H7-producing hybridoma cells using the Pharmingen (San Diego, Calif.) total RNA isolation kit (Catalog #45520K) according to the manufacturer's instructions accompanying the kit. One microgram (1 µg) of total RNA was used as template to prepare cDNA by reverse transcription. The RNA and 300 ng random primers were combined and denatured at 72° C. for 10 minutes prior to addition of enzyme. Superscript II reverse transcriptase (Life Technologies) was added to the RNA plus primer mixture in a total volume of 25 µl in the presence of 5× second strand buffer and 0.1 M DTT provided with the enzyme. The reverse transcription reaction was allowed to proceed at 42° C. for one hour.

The 2H7 cDNA generated in the randomly primed reverse transcriptase reaction and V region specific primers were used to amplify by PCR the variable regions for the light and heavy chain of the 2H7 antibody. The V region specific primers were designed using the published sequence (Genbank accession numbers M17954 for $V_L$ and M17953 for $V_H$) as a guide. The two variable chains were designed with compatible end sequences so that an scFv could be assembled by ligation of the two V regions after amplification and restriction enzyme digestion.

A $(Gly_4Ser)_3$ peptide linker to be inserted between the two V regions was incorporated by adding the extra nucleotides to the antisense primer for the $V_L$ of 2H7. A Sac I restriction site was also introduced at the junction between the two V regions. The sense primer used to amplify the 2H7 $V_L$, that included a HindIII restriction site and the light chain leader peptide was 5'-gtc <u>aag</u> ctt gcc gcc <u>atg</u> gat ttt caa gtg cag att ttt cag c-3' (SEQ ID NO:530). The antisense primer was 5'-gtc gtc <u>gagctc</u> cca cct cct cca gat cca cca ccg ccc gag cca ccg cca cct ttc agc tcc agc ttg gtc cc-3' (SEQ ID NO:531). The reading frame of the V region is indicated as a bold, underlined codon. The Hind III and SacI sites are indicated by underlined italicized sequences.

The $V_H$ domain was amplified without a leader peptide, but included a 5' SacI restriction site for fusion to the $V_L$ and a BclI restriction site at the 3' end for fusion to various tails, including the human IgG1 Fc domain and the truncated forms of CD40 ligand, CD154. The sense primer was 5'-gct gct <u>gagctc</u> tcaggc tta tct aca gca agt ctg g-3' (SEQ ID NO:532). The SacI site is indicated in italicized and underlined font, and the reading frame of the codon for the first amino acid of the $V_H$ domain is indicated in bold, underlined type. The antisense primer was 5'-gtt gtc <u>tgatcagag</u> acg gtg acc gtg gtc cc-3' (SEQ ID NO:533). The BclI site is indicated in italicized, underlined type, and the last serine of the $V_H$ domain sequence is indicated in bold, underlined type.

The scFv-Ig was assembled by inserting the 2H7 scFv HindIII-BclI fragment into pUC19 containing the human IgG1 hinge, CH2, and CH3 regions, which was digested with restriction enzymes, HindIII and BclI. After ligation, the ligation products were transformed into DH5a bacteria. Positive clones were screened for the properly inserted fragments using the SacI site at the $V_L$-$V_H$ junction of 2H7 as a diagnostic site. The 2H7scFv-Ig cDNA was subjected to cycle sequencing on a PE 9700 thermocycler using a 25-cycle program by denaturing at 96° C. for 10 seconds, annealing at 50° C. for 30 seconds, and extending at 72° C. for 4 minutes. The sequencing primers were pUC forward and reverse primers and an internal primer that annealed to the CH2 domain human in the IgG constant region portion. Sequencing reactions were performed using the Big Dye Terminator Ready Sequencing Mix (PE-Applied Biosystems, Foster City, Calif.) according to the manufacturer's instructions. Samples were subsequently purified using Centrisep columns (Catalog #CS-901, Princeton Separations, Adelphia, N.J.), the eluates dried in a Savant vacuum dryer, denatured in Template Suppression Reagent (PE-ABI), and analyzed on an ABI 310 Genetic Analyzer (PE-Applied Biosystems). The sequence was edited, translated, and analyzed using Vector Nti version 6.0 (Informax, North Bethesda, Md.). FIG. 1 shows the cDNA and predicted amino acid sequence of the 2H7scFv-Ig construct.

Example 2

Expression of 2H7 ScFv-Ig in Stable CHO Cell Lines

This Example illustrates expression of 2H7scFv-Ig in a eukaryotic cell line and characterization of the expressed 2H7scFv-Ig by SDS-PAGE and by functional assays, including ADCC and complement fixation.

The 2H7scFv-Ig HindIII-XbaI (~1.6 kb) fragment with correct sequence was inserted into the mammalian expression vector pD18, and DNA from positive clones was amplified using QIAGEN plasmid preparation kits (QIAGEN, Valencia, Calif.). The recombinant plasmid DNA (100 µg) was then linearized in a nonessential region by digestion with AscI, purified by phenol extraction, and resuspended in tissue culture media, Excell 302 (Catalog #14312-79P, JRH Biosciences, Lenexa, Kans.). Cells for transfection, CHO DG44 cells, were kept in logarithmic growth, and $10^7$ cells harvested for each transfection reaction. Linearized DNA was added to the CHO cells in a total volume of 0.8 ml for electroporation.

Stable production of the 2H7 scFv-Ig fusion protein (SEQ. ID NO:10) was achieved by electroporation of a selectable, amplifiable plasmid, pD18, containing the 2H7 scFv-Ig cDNA under the control of the CMV promoter, into Chinese Hamster Ovary (CHO) cells (all cell lines from American Type Culture Collection, Manassas, Va., unless otherwise noted). The 2H7 expression cassette was subcloned downstream of the CMV promoter into the vector multiple cloning site as a ~1.6 kb HindIII-XbaI fragment. The pD18 vector is a modified version of pcDNA3 encoding the DHFR selectable marker with an attenuated promoter to increase selection pressure for the plasmid. Plasmid DNA was prepared using Qiagen maxiprep kits, and purified plasmid was linearized at a unique AscI site prior to phenol extraction and ethanol precipitation. Salmon sperm DNA (Sigma-Aldrich, St. Louis, Mo.) was added as carrier DNA, and 100 µg each of plasmid and carrier DNA was used to transfect $10^7$ CHO DG44 cells by electroporation. Cells were grown to logarithmic phase in Excell 302 media (JRH Biosciences) containing glutamine (4 mM), pyruvate, recombinant insulin, penicillin-streptomycin, and 2×DMEM nonessential amino acids (all from Life Technologies, Gaithersburg, Md.), hereafter referred to as "Excell 302 complete" media. Media for untransfected cells also contained HT (diluted from a 100× solution of hypoxanthine and thymidine) (Invitrogen/Life Technologies). Media for transfections under selection contained varying levels of methotrexate (Sigma-Aldrich) as selective agent, ranging from 50 nM to 5 µM. Electroporations were performed at 275 volts, 950 µF. Transfected cells were allowed to recover overnight in non-selective media prior to selective plating in 96 well flat bottom plates (Costar) at varying serial dilutions ranging from 125 cells/well to 2000 cells/well. Culture media for cell cloning was Excell 302 complete, containing 100 nM methotrexate. Once clonal outgrowth was sufficient, serial dilutions of culture supernatants from master wells were screened for binding to CD20-CHO transfected cells. The clones with the highest production of the fusion protein were expanded into T25 and then T75 flasks to provide adequate numbers of cells for freezing and for scaling up production of the 2H7scFvIg. Production levels were further increased in cultures from three clones by progressive amplification in methotrexate containing culture media. At each successive passage of cells, the Excell 302 complete media contained an increased concentration of methotrexate, such that only the cells that amplified the DHFR plasmid could survive.

Supernatants were collected from CHO cells expressing the 2H7scFv-Ig, filtered through 0.2 µm PES express filters (Nalgene, Rochester, N.Y.) and were passed over a Protein A-agarose (IPA 300 crosslinked agarose) column (Repligen, Needham, Mass.). The column was washed with PBS, and then bound protein was eluted using 0.1 M citrate buffer, pH 3.0. Fractions were collected and eluted protein was neutralized using 1M Tris, pH 8.0, prior to dialysis overnight in PBS. Concentration of the purified 2H7scFv-Ig was determined by absorption at 280 nm. An extinction coefficient of 1.77 was determined using the protein analysis tools in the Vector Nti Version 6.0 Software package (Informax, North Bethesda, Md.). This program uses the amino acid composition data to calculate extinction coefficients.

Figure 2:
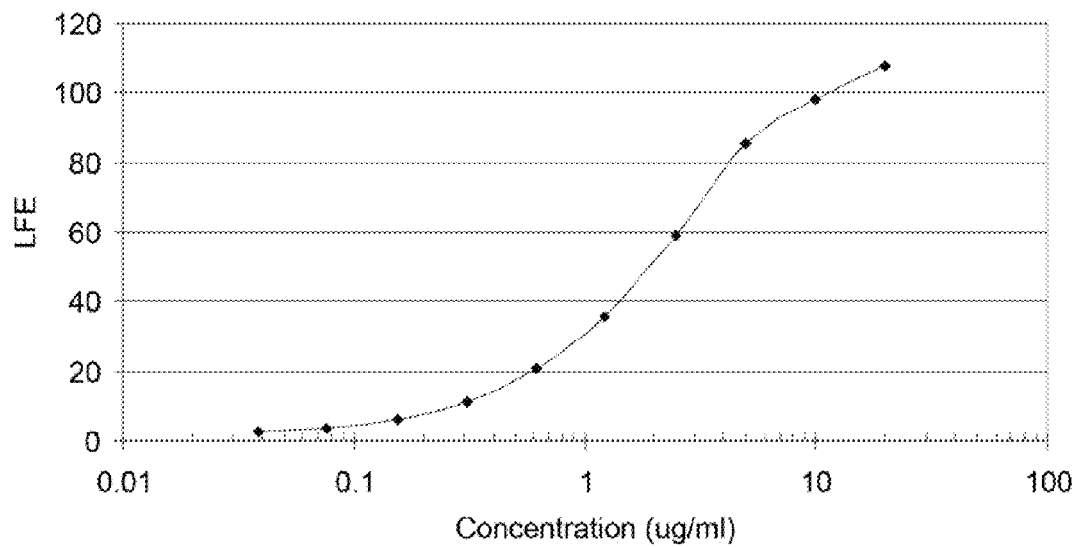
FIG. 2 shows production levels of 2H7 scFv-Ig by transfected, stable CHO lines and generation of a standard curve by binding of purified 2H7 scFv-Ig to CHO cells expressing CD20.

Production levels of 2H7scFv-Ig by transfected, stable CHO cells were analyzed by flow cytometry. Purified 2H7scFv-Ig to CHO cells was allowed to bind to CHO cells that expressed CD20 (CD20 CHO) and analyzed by flow cytometry using a fluorescein-conjugated anti-human IgG second step reagent (Catalog Numbers H10101 and H10501, CalTag, Burlingame, Calif.). FIG. 2 (top) shows a standard curve generated by titration of 2H7scFv-Ig binding to CD20 CHO. At each concentration of 2H7scFv-Ig, the mean brightness of the fluorescein signal in linear units is shown. Supernatants collected from T flasks containing stable CHO cell clones expressing 2H7scFv-Ig were then allowed to bind to CD20 CHO and the binding was analyzed by flow cytometry. The fluorescein signal generated by 2H7scFv-Ig contained in the supernatants was measured and the 2H7scFv-Ig concentration in the supernatants was calculated from the standard curve (FIG. 2, bottom).

Figure 3:
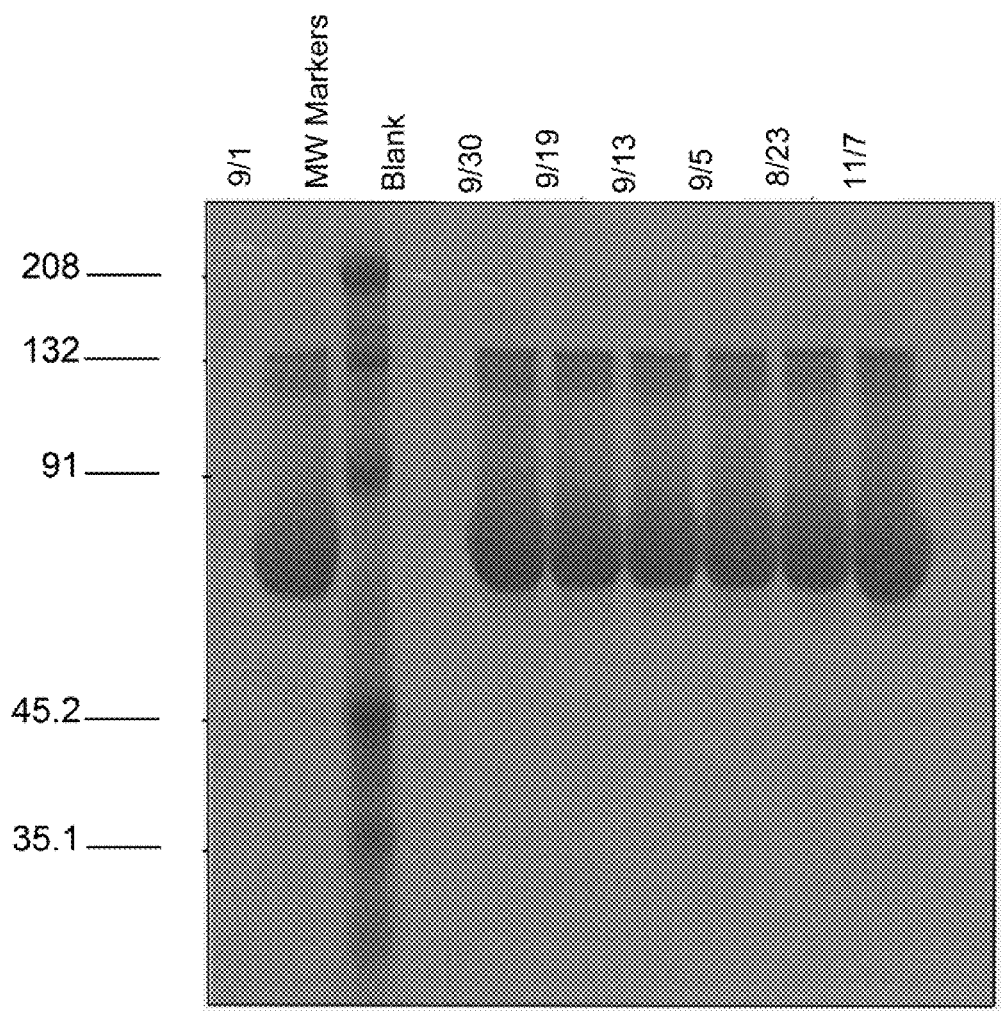
FIG. 3 shows SDS-PAGE analysis of multiple preparations of isolated 2H7scFv-Ig protein.

Purified 2H7scFv-Ig was analyzed by electrophoresis on SDS-Polyacrylamide gels. Samples of 2H7scFv-Ig, purified by independent Protein A Agarose column runs, were boiled in SDS sample buffer without reduction of disulfide bonds and applied to SDS 10% Tris-BIS gels (Catalog #NP0301, Novex, Carlsbad, Calif.). Twenty micrograms of each purified batch was loaded on the gels. The proteins were visualized after electrophoresis by Coomassie Blue staining (Pierce Gel Code Blue Stain Reagent, Catalog #24590, Pierce, Rockford, Ill.), and destaining in distilled water. Molecular weight markers were included on the same gel (Kaleidoscope Prestained Standards, Catalog #161-0324, Bio-Rad, Hercules, Calif.). The results are presented in FIG. 3. The numbers above the lanes designate independent purification batches. The molecular weights in kilodaltons of the size markers are indicated on the left side of the figure. Further experiments with alternative sample preparation conditions indicated that reduction of disulfide bonds by boiling the protein in SDS sample buffer containing DTT or 2-mercaptoethanol caused the 2H7scFv-Ig to aggregate.

Any number of other immunological parameters may be monitored using routine assays that are well known in the art. These may include, for example, antibody dependent cell-mediated cytotoxicity (ADCC) assays, secondary in vitro antibody responses, flow immunocytofluorimetric analysis of various peripheral blood or lymphoid mononuclear cell subpopulations using well established marker antigen systems, immunohistochemistry or other relevant assays. These and other assays may be found, for example, in Rose et al. (Eds.), *Manual of Clinical Laboratory Immunology*, $5^{th}$ Ed., a 1997 American Society of Microbiology, Washington, D.C.

The ability of 2H7scFv-Ig to kill CD20 positive cells in the presence of complement was tested using B cell lines Ramos and Bjab. Rabbit complement (Pel-Freez, Rogers, Ak.) was used in the assay at a final dilution of $\frac{1}{10}$. Purified 2H7scFv-Ig was incubated with B cells and complement for 45 minutes at 37° C., followed by counting of live and dead cells by trypan blue exclusion. The results in FIG. 4A show that in the presence of rabbit complement, 2H7scFv-Ig lysed B cells expressing CD20.

The ability of 2H7scFv-Ig to kill CD20 positive cells in the presence of peripheral blood mononuclear cells (PBMC) was tested by measuring the release of $^{51}Cr$ from labeled Bjab cells in a 4-hour assay using a 100:1 ratio of PBMC to Bjab cells. The results shown in FIG. 4B indicated that 2H7scFv-Ig can mediate antibody dependent cellular cytotoxicity (ADCC) because the release of $^{51}$Cr was higher in the presence of both PBMC and 2H7scFv-Ig than in the presence of either PBMC or 2H7scFv-Ig alone.

Example 3

Effect of Simultaneous Ligation of CD20 and CD40 on Growth of Normal B Cells, and on CD95 Expression, and Induction of Apoptosis This Example illustrates the effect on cell proliferation of cross-linking of CD20 and CD40 expressed on the cell surface.

Figure 5:
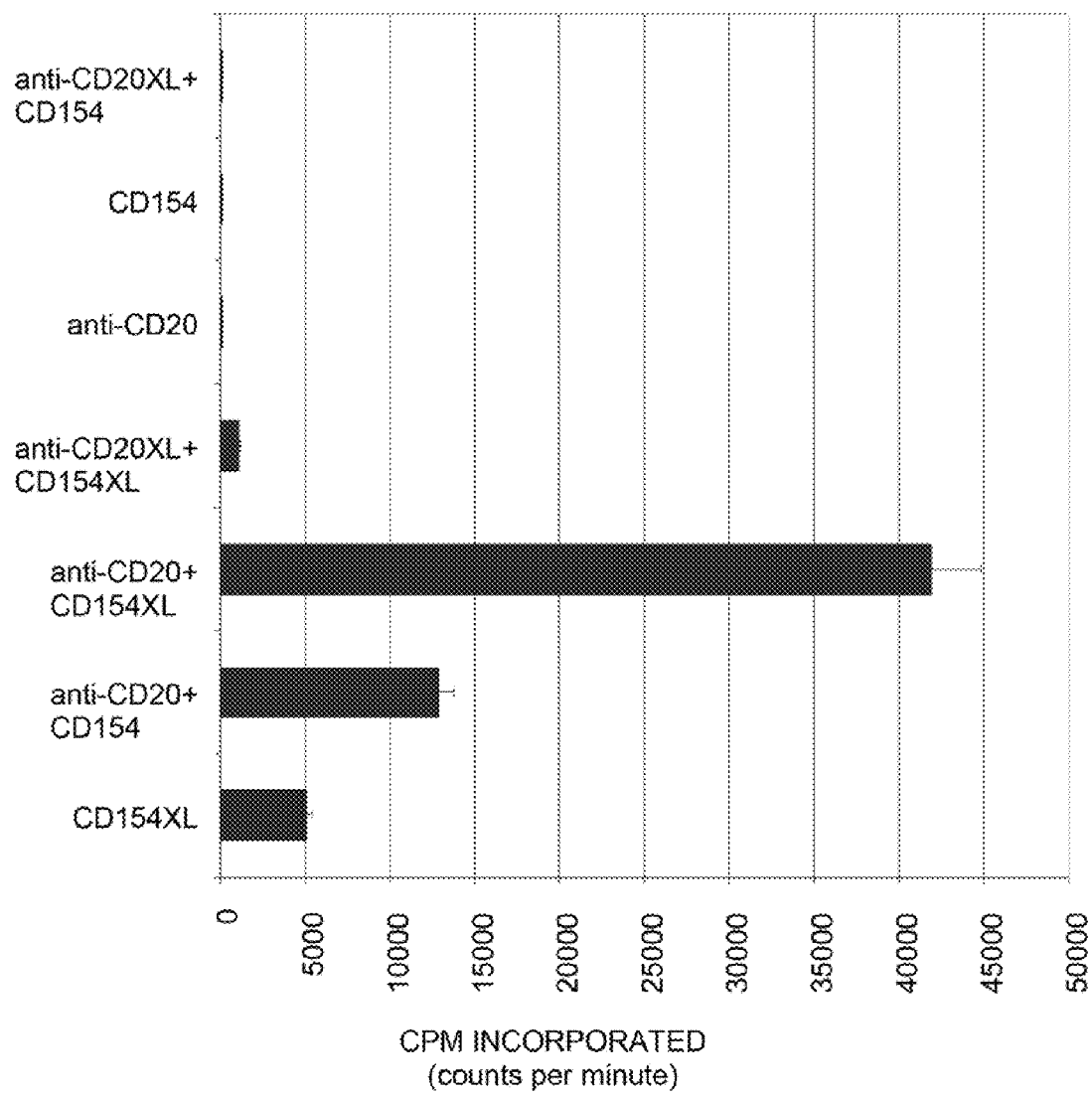
FIG. 5 shows the effect of simultaneous ligation of CD20 and CD40 on growth of normal B cells.

Dense resting B cells were isolated from human tonsil by a Percoll step gradient and T cells were removed by E-rosetting. Proliferation of resting, dense tonsillar B cells was measured by uptake of $^3$[H]-thymidine during the last 12 hours of a 4-day experiment. Proliferation was measured in quadruplicate cultures with means and standard deviations as shown. Murine anti-human CD20 monoclonal antibody 1F5 (anti-CD20) was used alone or was cross-linked with anti-murine κ monoclonal antibody 187.1 (anti-CD20XL). CD40 activation was accomplished using soluble human CD154 fused with murine CD8 (CD154) (Hollenbaugh et al., *EMBO J.* 11: 4212-21 (1992)), and CD40 cross-linking was accomplished using anti-murine CD8 monoclonal antibody 53-6 (CD154XL). This procedure allowed simultaneous cross-linking of CD20 and CD40 on the cell surface. The results are presented in FIG. 5.

The effect of CD20 and CD40 cross-linking on Ramos cells, a B lymphoma cell line, was examined. Ramos cells were analyzed for CD95 (Fas) expression and percent apoptosis eighteen hours after treatment (no goat anti-mouse IgG (GAM)) and/or cross-linking (+GAM) using murine monoclonal antibodies that specifically bind CD20 (1F5) and CD40 (G28-5). Control cells were treated with a non-binding isotype control (64.1) specific for CD3.

Figure 6A:
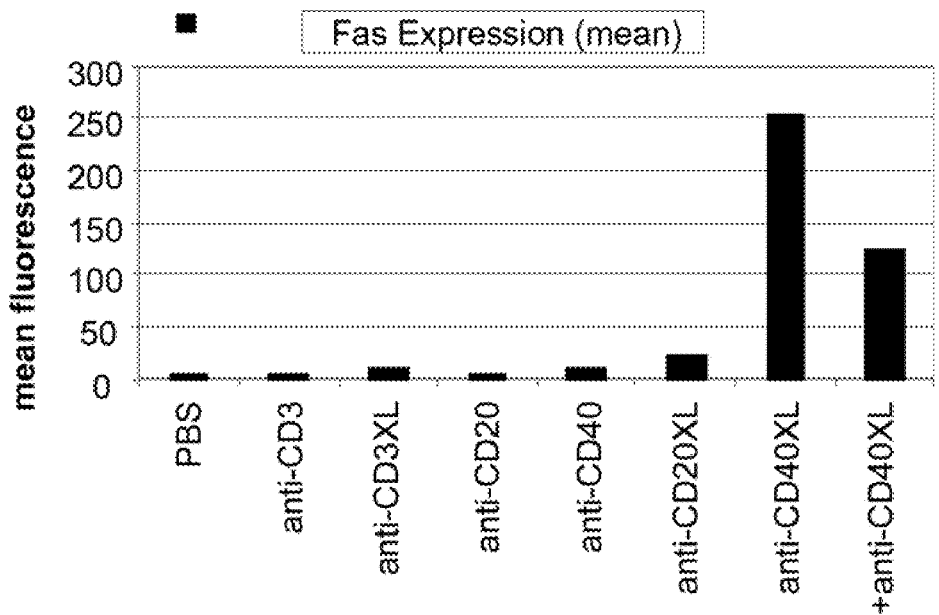
FIG. 6 shows the effect of simultaneous ligation of CD20 and CD40 on CD95 expression and induction of apoptosis in a B lymphoblastoid cell line.

Treated Ramos cells were harvested, incubated with FITC-anti-CD95, and analyzed by flow cytometry to determine the relative expression level of Fas on the cell surface after CD20 or CD40 cross-linking. Data is plotted as mean fluorescence of cells after treatment with the stimuli indicated (FIG. 6A).

Figure 6B:
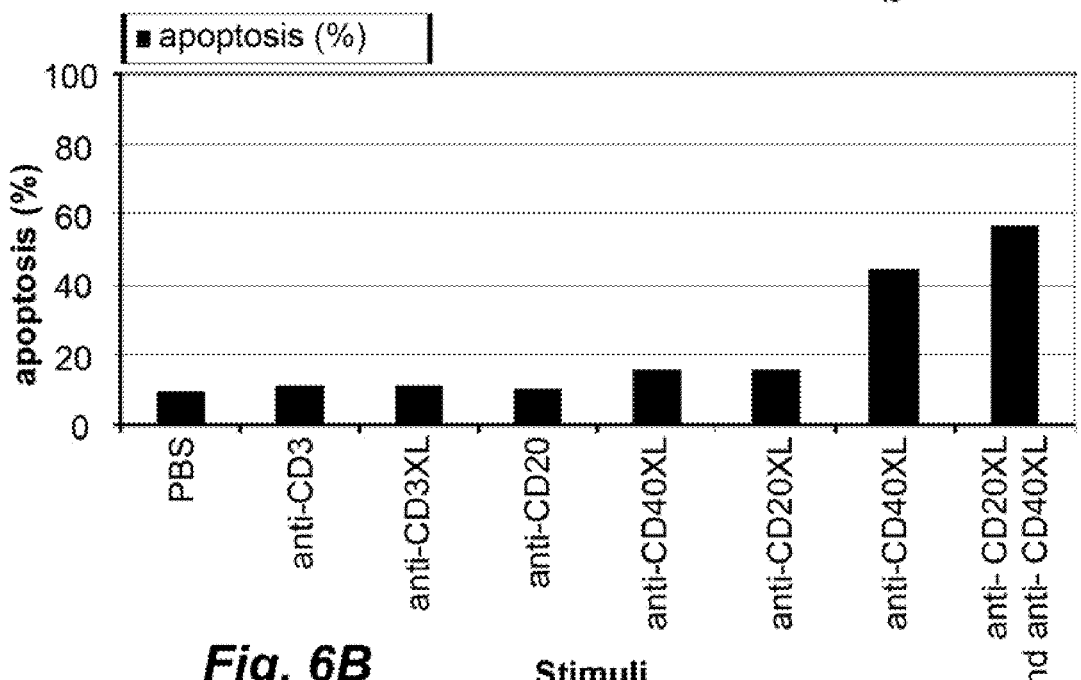

Treated Ramos cells from the same experiment were harvested and binding of annexin V was measured to indicate the percentage apoptosis in the treated cultures. Apoptosis was measured by binding of Annexin V 18 hours after cross-linking of CD20 and CD40 using 1F5 and G28-5 followed by cross-linking with GAM. Binding of Annexin V was measured using a FITC-Annexin V kit (Catalog #PN-IM2376, Immunotech, Marseille, France,). Annexin V binding is known to be an early event in progression of cells into apoptosis. Apoptosis, or programmed cell death, is a process characterized by a cascade of catabolic reactions leading to cell death by suicide. In the early phase of apoptosis, before cells change morphology and hydrolyze DNA, the integrity of the cell membrane is maintained but cells lose the asymmetry of their membrane phospholipids, exposing negatively charged phospholipids, such as phosphatidylserine, at the cell surface. Annexin V, a calcium and phopholipid binding protein, binds preferentially and with high affinity to phosphatidylserine. Results demonstrating the effect of cross-linking both CD20 and CD40 on expression of the FAS receptor (CD95) are presented in FIG. 6B. The effect of cross-linking of both CD20 and CD40 on Annexin V binding to cells is shown in FIG. 6B.

Example 4

Construction and Characterization of 2H7 ScFv-CD154 Fusion Proteins

To construct a molecule capable of binding to both CD20 and CD40, cDNA encoding the 2H7 scFv was fused with cDNA encoding CD154, the CD40 ligand. The 2H7 scFv cDNA encoded on the HindIII-BclI fragment was removed from the 2H7 scFvIg construct, and inserted into a pD18 vector along with a BamHI-XbaI cDNA fragment encoding the extracellular domain of human CD154. The extracellular domain is encoded at the carboxy terminus of CD154, similar to other type II membrane proteins.

The extracellular domain of human CD154 was PCR amplified using cDNA generated with random primers and RNA from human T lymphocytes activated with PHA (phytohemagglutinin). The primer sets included two different 5' or sense primers that created fusion junctions at two different positions within the extracellular domain of CD154. Two different fusion junctions were designed that resulted in a short or truncated form (form S4) including amino acids 108 (Glu)-261 (Leu)+(Glu), and a long or complete form (form L2) including amino acids 48 (Arg)-261 (Leu)+(Glu), of the extracellular domain of CD154, both constructed as BamHI-XbaI fragments. The sense primer that fuses the two different truncated extracellular domains to the 2H7scFv includes a BamHI site for cloning. The sense primer for the S4 form of the CD154 cDNA is designated SEQUENCE ID NO: 535 or CD154BAM108 and encodes a 34 mer with the following sequence: 5'-gtt gtc gga tcc aga aaa cag ctt tga aat gca a-3', while the antisense primer is designated SEQUENCE ID NO: 536 or CD154XBA and encodes a 44 mer with the following sequence: 5'-gtt gtt tct aga tta tca ctc gag ttt gag taa gcc aaa gga cg-3' (SEQ ID NO:536).

The oligonucleotide primers used in amplifying the long form (L2) of the CD154 extracellular domain encoding amino acids 48 (Arg)-261 (Leu)+(Glu), were as follows: The sense primer designated CD154 BAM48 (SEQUENCE ID NO:537) encoded a 35-mer with the following sequence: 5'-gtt gtc gga tcc aag aag gtt gga caa gat aga ag-3'. The antisense primer designated or CD154XBA (SEQUENCE ID NO:538) encoded the 44-mer: 5'-gtt gtt tct aga tta tca ctc gag ttt gag taa gcc aaa gga cg-3'. Other PCR reaction conditions were identical to those used for amplifying the 2H7 scFv (see Example 1). PCR fragments were purified by PCR quick kits (QIAGEN, San Diego, Calif.), eluted in 30 µl ddH$_2$O, and digested with BamHI and XbaI (Roche) restriction endonucleases in a 40 µl reaction volume at 37° C. for 3 hours. Fragments were gel purified, purified using QIAEX kits according to the manufacturer's instructions (QIAGEN), and ligated along with the 2H7 HindIII-BclI fragment into the pD18 expression vector digested with HindIII+XbaI. Ligation reactions were transformed into DH5-alpha chemically competent bacteria and plated onto LB plates containing 100 µg/ml ampicillin. Transformants were grown overnight at 37° C., and isolated colonies used to inoculate 3 ml liquid cultures in Luria Broth containing 100 µg/ml ampicillin. Clones were screened after mini-plasmid preparations (QIAGEN) for insertion of both the 2H7 scFv and the CD154 extracellular domain fragments.

The 2H7scFv-CD154 construct cDNAs were subjected to cycle sequencing on a PE 9700 thermocycler using a 25-cycle program that included denaturating at 96° C., 10 seconds, annealing at 50° C. for 5 seconds, and extension at 60° C., for 4 minutes. The sequencing primers used were pD18 forward (SEQ ID NO:539: 5'-gtctatataagcagagctctggc-3') and pD18 reverse (SEQ ID NO:540: 5'-cgaggctgatcagcgagctctagca-3') primers. In addition, an internal primer was used that had homology to the human CD154 sequence (SEQ ID NO:541: 5'-ccgcaatttgaggattctgatcacc-3'). Sequencing reactions included primers at 3.2 pmol, approximately 200 ng DNA template, and 8 µl sequencing mix. Sequencing reactions were performed using the Big Dye Terminator Ready Sequencing Mix (PE-Applied Biosystems, Foster City, Calif.) according to the manufacturer's instructions. Samples were subsequently purified using Centrisep columns (Princeton Separations, Adelphia, N.J.). The eluates were dried in a Savant speed-vacuum dryer, denatured in 20 µl template Suppression Reagent (ABI) at 95° C. for 2 minutes, and analyzed on an ABI 310 Genetic Analyzer (PE-Applied Biosystems). The sequence was edited, translated, and analyzed using Vector Nti version 6.0 (Informax, North Bethesda, Md.). The 2H7scFv-CD154 L2 cDNA sequence and predicted amino acid sequence is presented in FIG. 7A, and 2H7scFv-CD154 S4 cDNA sequence and predicted amino acid sequence is presented in FIG. 7B.

Figure 8:
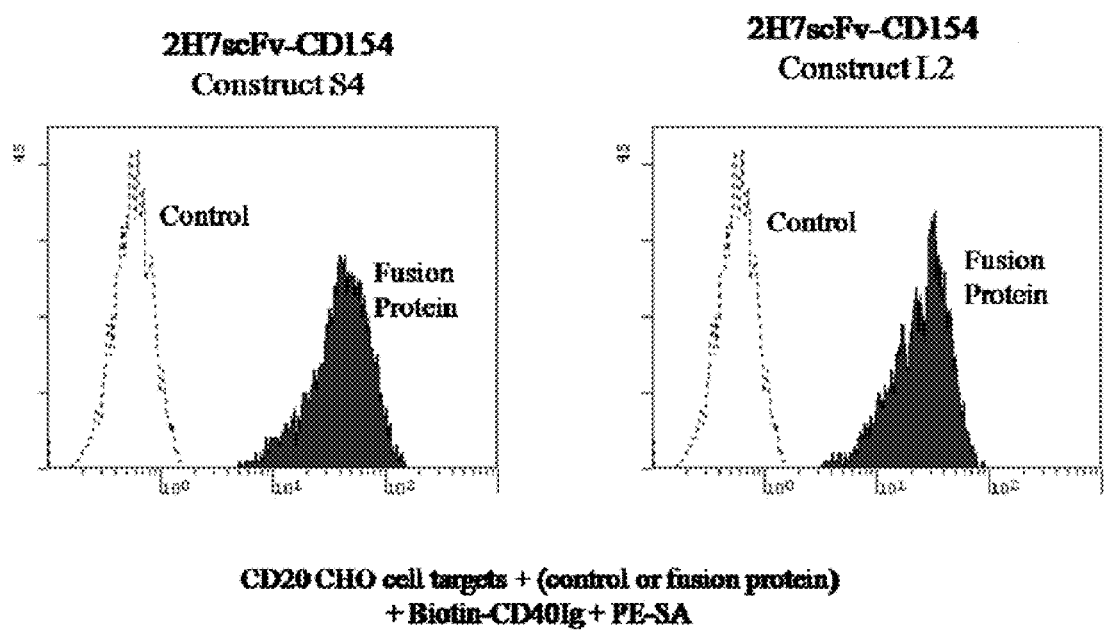
FIG. 8 shows binding of 2H7scFv-CD154 binding domain-immunoglobulin fusion proteins to CD20+CHO cells by flow immunocytofluorimetry.

The binding activity of the 2H7 scFv-CD154 fusion proteins (SEQ. ID NOs: 691 and 693) to CD20 and CD40 simultaneously was determined by flow cytometry. The assay used CHO cell targets that express CD20. After a 45-minute incubation of CD20 CHO cells with supernatants from cells transfected with the 2H7 scFv-CD 154 expression plasmid, the CD20 CHO cells were washed twice and incubated with biotin-conjugated CD40-Ig fusion protein in PBS/2% FBS. After 45 min, cells were washed twice and incubated with phycoerythrin (PE)-labeled strepavidin at 1:100 in PBS/2% FBS (Molecular Probes, Eugene Oreg.). After an additional 30 min incubation, cells were washed 2× and were analyzed by flow cytometry. The results show that the 2H7 scFv-CD154 molecule was able to bind to CD20 on the cell surface and to capture biotin-conjugated CD40 from solution (FIG. 8).

Figure 9:
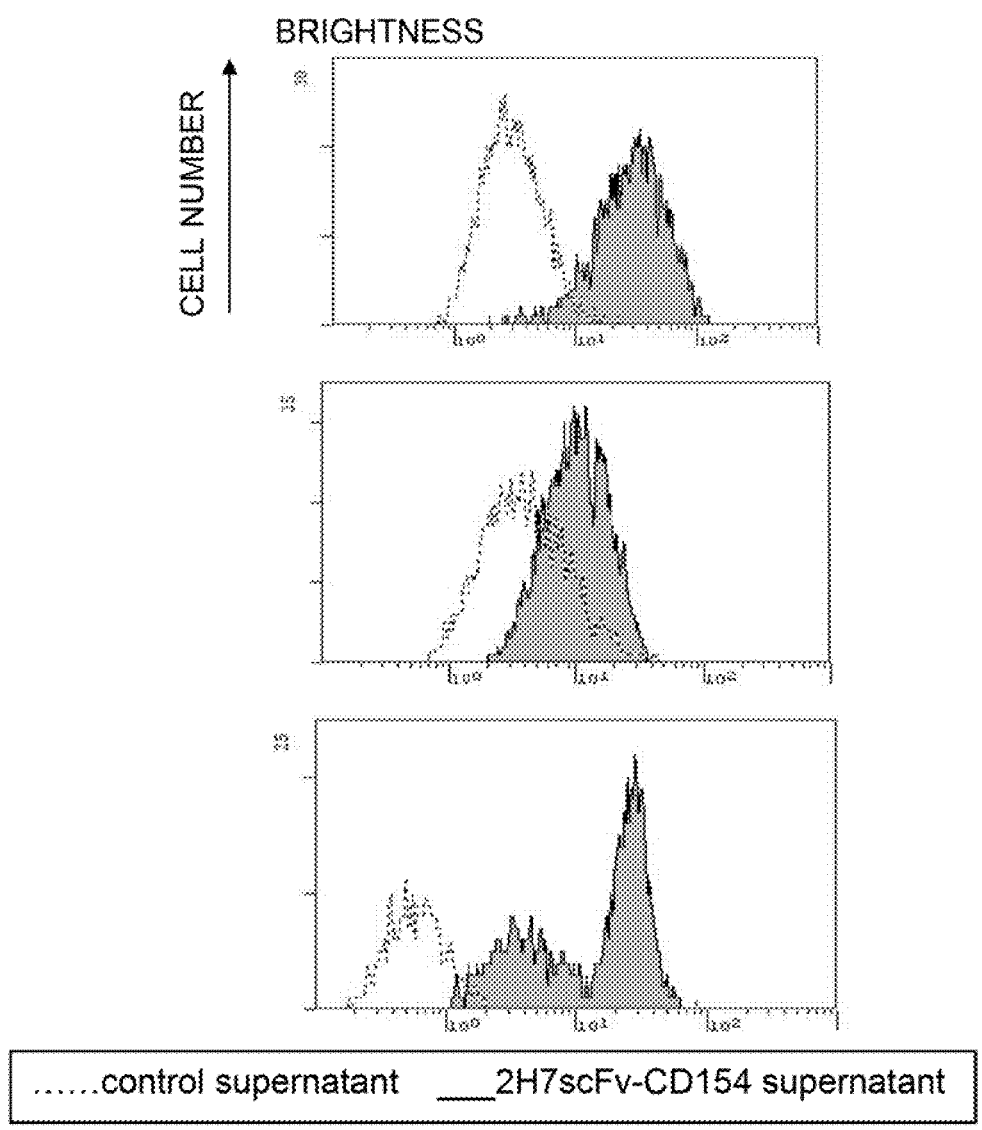
FIG. 9 shows binding of Annexin V to B cell lines Ramos, BJAB, and T51 after binding of 2H7scFv-CD154 binding domain-immunoglobulin fusion protein to cells.

To determine the effect of the 2H7scFv-CD 154 on growth and viability of B lymphoma and lymphoblastoid cell lines, cells were incubated with 2H7scFv-CD154 L2 (SEQ. ID NO:691) for 12 hours and then examined for binding of Annexin V. Binding of Annexin V was measured using a FITC-Annexin V kit (Immunotech, Marseille, France, Catalog #PN-IM2376). B cell lines were incubated in 1 ml cultures with dilutions of concentrated, dialyzed supernatants from cells expressing secreted forms of the 2H7scFv-CD154 fusion proteins. The results are presented in FIG. 9.

Figure 10:
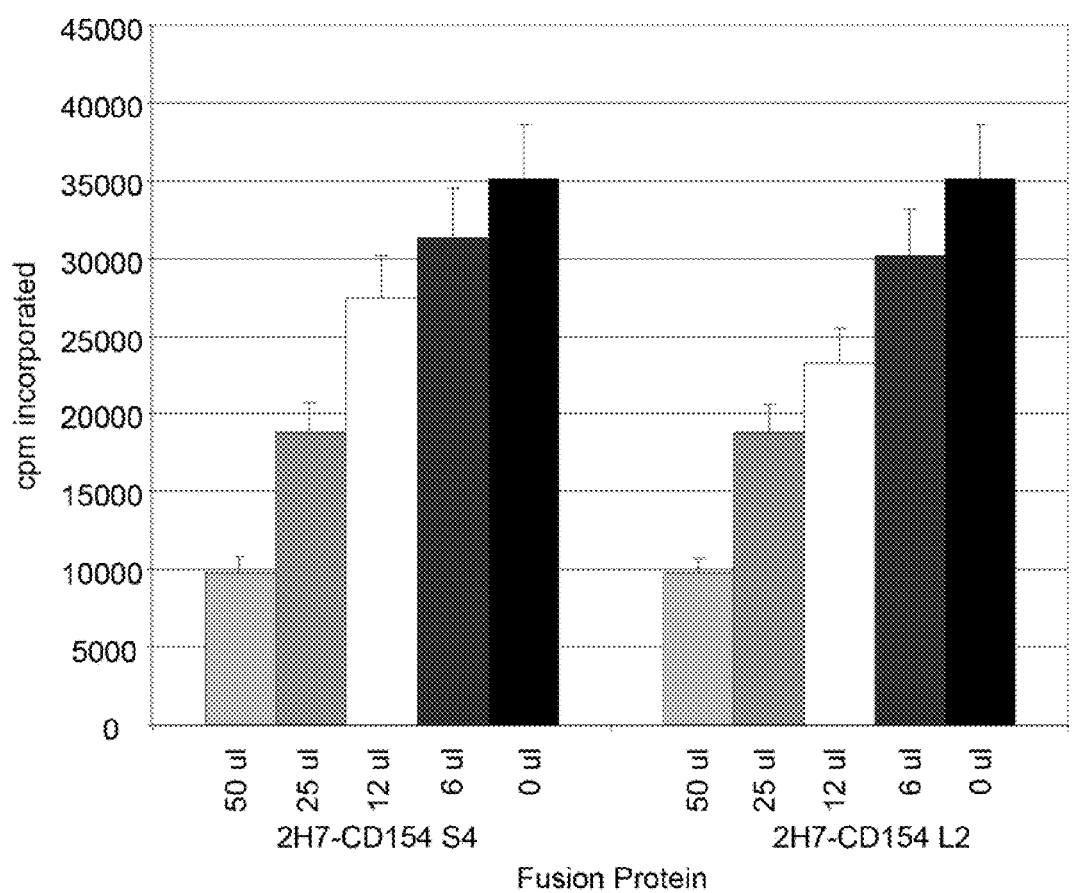
FIG. 10 shows effects on proliferation of B cell line T51 following binding of 2H7scFv-CD154 binding domain-immunoglobulin fusion protein.

The growth rate of the Ramos B lymphoma cell line in the presence of 2H7scFv-CD154 was examined by uptake of $^3$H-thymidine for the last 6 hours of a 24-hour culture. The effect of 2H7scFv-CD154 on cell proliferation is shown in FIG. 10.

Example 5

Construction and Characterization of CytoxB Antibody Derivatives

CytoxB antibodies were prepared using 2H7 scFv-IgG polypeptide. The 2H7 scFv (see Example 1) was linked to the human IgG1 Fc domain via an altered hinge domain (see FIG. 11). Cysteine residues in the hinge region were substituted with serine residues by site-directed mutagenesis and other methods known in the art. The mutant hinge was fused either to a wild-type Fc domain to create one construct, designated CytoxB-MHWTG1C, or was fused to a mutated Fc domain (CytoxB-MHMG1C) that had additional mutations introduced into the CH2 domain. Amino acid residues in CH2 that are implicated in effector function are illustrated in FIG. 11. Mutations of one or more of these residues may reduce FcR binding and mediation of effector functions. In this Example, the leucine residue 234 known in the art to be important to Fc receptor binding, was mutated in the 2H7 scFv fusion protein, CytoxB-[MG1H/MG1C]. In another construct, the human IgG1 hinge region was substituted with a portion of the human IgA hinge, which was fused to wild-type human Fc domain (CytoxB-IgAHWTHG1C). (See FIG. 11). This mutated hinge region allows expression of a mixture of monomeric and dimeric molecules that retain functional properties of the human IgG1 CH2 and CH3 domains. Synthetic, recombinant cDNA expression cassettes for these molecules were constructed and polypeptides were expressed in CHODG44 cells according to methods described in Example 2.

Figure 12:
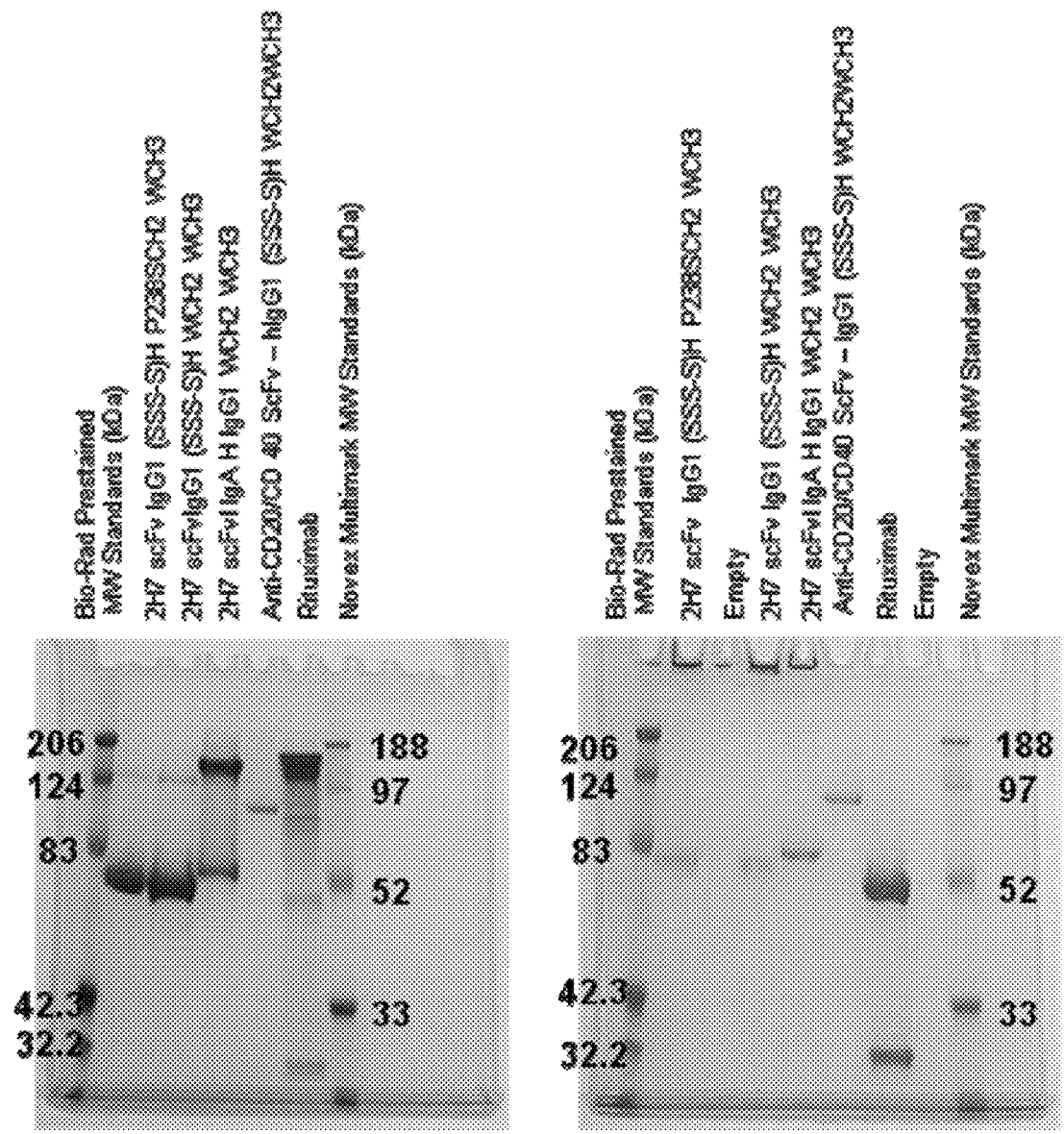
FIG. 12 shows SDS-PAGE analysis of isolated CytoxB and 2H7scFv-CD154 binding domain-immunoglobulin fusion proteins.

Purified fusion protein derivatives of CytoxB-scFvIg molecules were analyzed by SDS-PAGE according to the methods described in Example 2. Polyacrylamide gels were run under non-reducing and reducing conditions. Two different molecule weight marker sets, BioRad prestained markers, (BioRad, Hercules, Calif.) and Novex Multimark molecular weight markers were loaded onto each gel. The migration patterns of the different constructs and of Rituximab™ are presented in FIG. 12.

Figure 13:
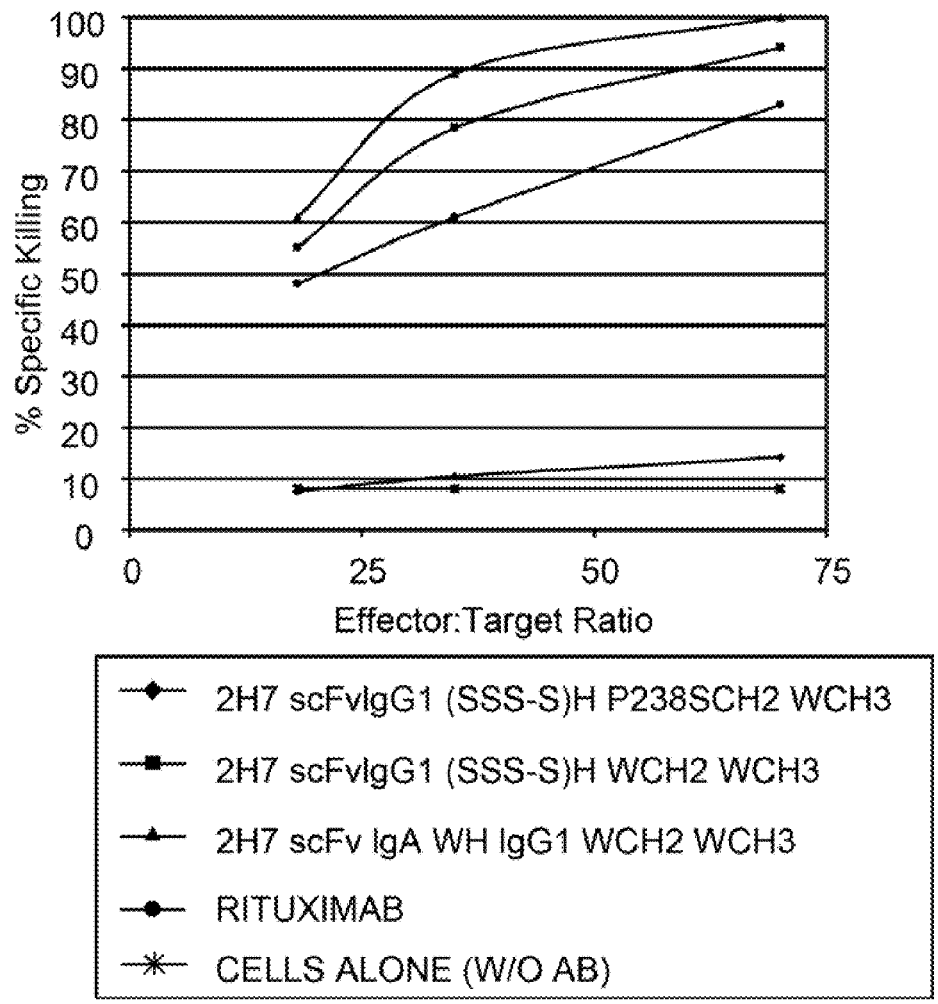
FIG. 13 shows antibody dependent cell-mediated cytotoxicity activity of CytoxB derivatives.

The ability of the different derivatives of CytoxB-scFvIg molecules to mediate ADCC was measured using the Bjab B lymphoma cells as the target and freshly prepared human PBMCs as effector cells. (See Example 2). Effector to target ratios were varied as follows: 70:1, 35:1, and 18:1, with the number of Bjab cells per well remaining constant but the number of PBMCs were varied. Bjab cells were labeled for 2 hours with $^{51}$Cr and aliquoted at a cell density of 5×10$^4$ cells/well to each well of flat-bottom 96 well plates. Purified fusion proteins or rituximab were added at a concentration of 10 µg/ml to the various dilutions of PBMCs. Spontaneous release was measured without addition of PBMC or fusion protein, and maximal release was measured by the addition of detergent (1% NP-40) to the appropriate wells. Reactions were incubated for 4 hours, and 100 µl of culture supernatant was harvested to a Lumaplate (Packard Instruments) and allowed to dry overnight prior to counting cpm released. The results are presented in FIG. 13.

Figure 14:
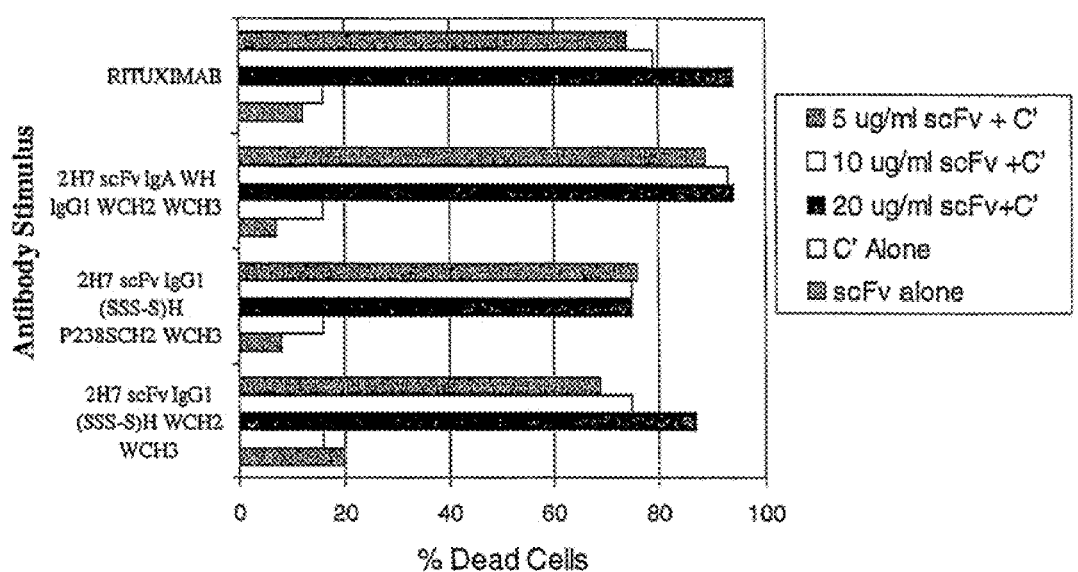
FIG. 14 shows complement dependent cytotoxicity of CytoxB derivatives.

Complement dependent cytotoxicity (CDC) activity of the CytoxB derivatives was also measured. Reactions were performed essentially as described in Example 2. The results are presented in FIG. 14 as percent of dead cells to total cells for each concentration of fusion protein.

Example 6

In Vivo Studies in Macaques

Figure 15:
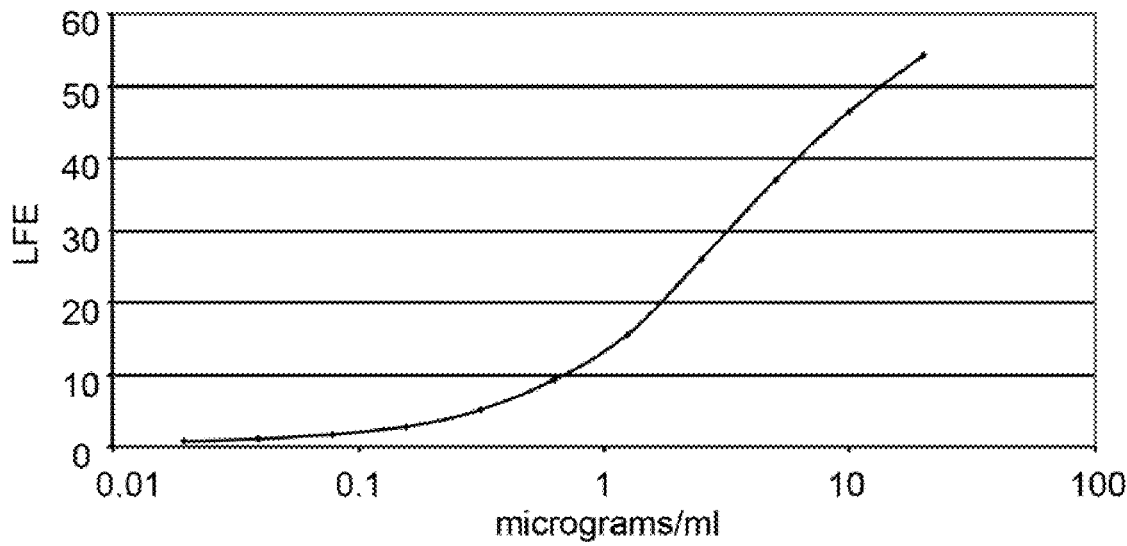
FIG. 15 shows serum half-life determinations of CytoxB-MHWTG1C in macaque blood samples.

Initial in vivo studies with CytoxB derivatives have been performed in nonhuman primates. FIG. 15 shows data characterizing the serum half-life of CytoxB in monkeys. Measurements were performed on serum samples obtained from two different macaques (J99231 and K99334) after doses of 6 mg/kg were administered to each monkey on the days indicated by arrows. For each sample, the level of 2H7scFvIg present was estimated by comparison to a standard curve generated by binding of purified CytoxB-(MHWTG1C)-Ig fusion protein to CD20 CHO cells (see Example 2). The data are tabulated in the bottom panel of the FIG. 15.

The effect of CytoxB-(MHWTG1C)Ig fusion protein on levels of circulating CD40+ cells in macaques was investigated. Complete blood counts were performed at each of the days indicated in FIG. 16. In addition, FACS (fluorescence activated cell sorter) assays were performed on peripheral blood lymphocytes using a CD40-specific fluorescein conjugated antibody to detect B cells among the cell population. The percentage of positive cells was then used to calculate the number of B cells in the original samples. The data are graphed as thousands of B cells per microliter of blood measured at the days indicated after injection (FIG. 16).

Example 7

Construction and Expression of an Anti-CD19 scFv-Ig Fusion Protein

Figure 17:
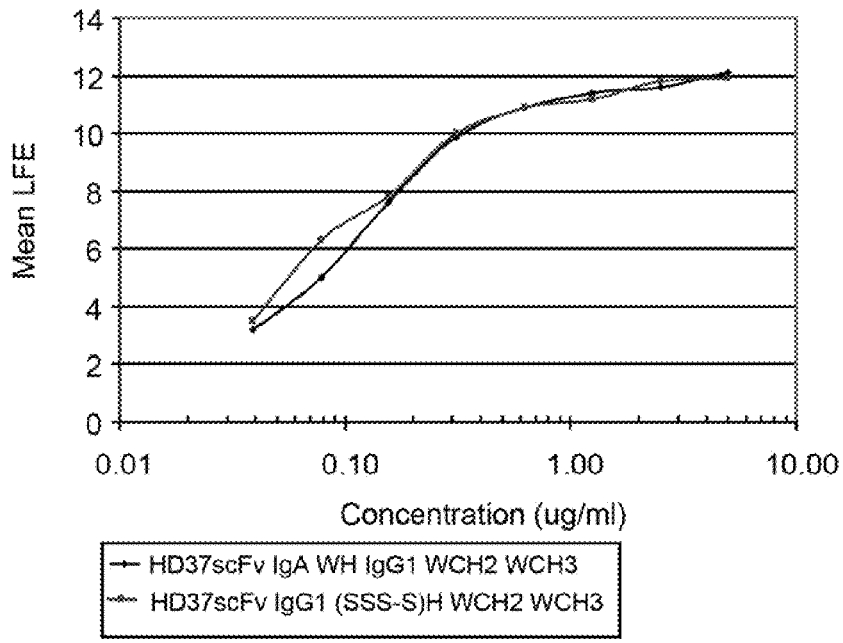
FIG. 17 shows production levels of HD37 (CD19-specific) ScFv-Ig by transfected mammalian cell lines and generation of a standard curve by binding of purified HD37 ScFv-Ig to cells expressing CD19.

An anti-CD19 scFv-Ig fusion protein was constructed, transfected into eukaryotic cells, and expressed according to methods presented in Examples 1, 2, and 5 and standard in the art. The variable heavy chain regions and variable light chain regions were cloned from RNA isolated from hybridoma cells producing antibody HD37, which specifically binds to CD19. Expression levels of a HD37scFv-IgAHWTG1C and a HD37scFv-IgMHWTG1C were measured and compared to a standard curve generated using purified HD37 scFvIg. The results are presented in FIG. 17.

Example 8

Construction and Expression of an Anti-L6 scFv-Ig Fusion Protein

Figure 18:
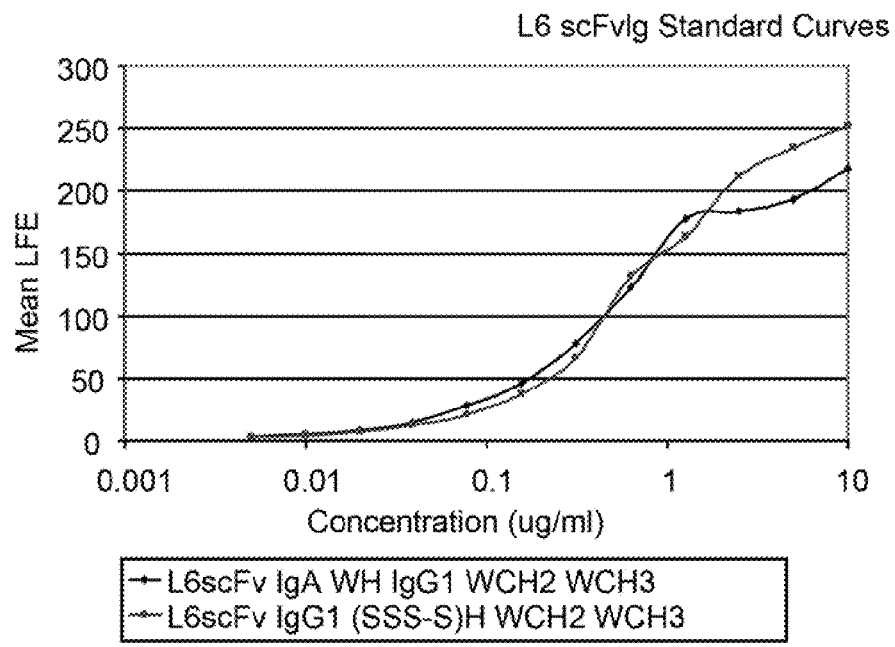
FIG. 18 shows production levels of L6 (carcinoma antigen) ScFv-Ig by transfected, stable CHO lines and generation of a standard curve by binding of purified L6 ScFv-Ig to cells expressing L6 antigen.

An scFv-Ig fusion protein was constructed using variable regions derived from an anti-carcinoma monoclonal antibody, L6. The fusion protein was constructed, transfected into eukaryotic cells, and expressed according to methods presented in Examples 1, 2, and 5 and standard in the art. Expression levels of L6 scFv-IgAH WCH2 CH3 and L6 scFv-(SSS-S)H WCH2 WCH3 were measured and compared to a standard curve generated using purified L6 scFvIg. The results are presented in FIG. 18.

Example 9

Characterization of Various scFv-Ig Fusion Proteins

Figure 20:
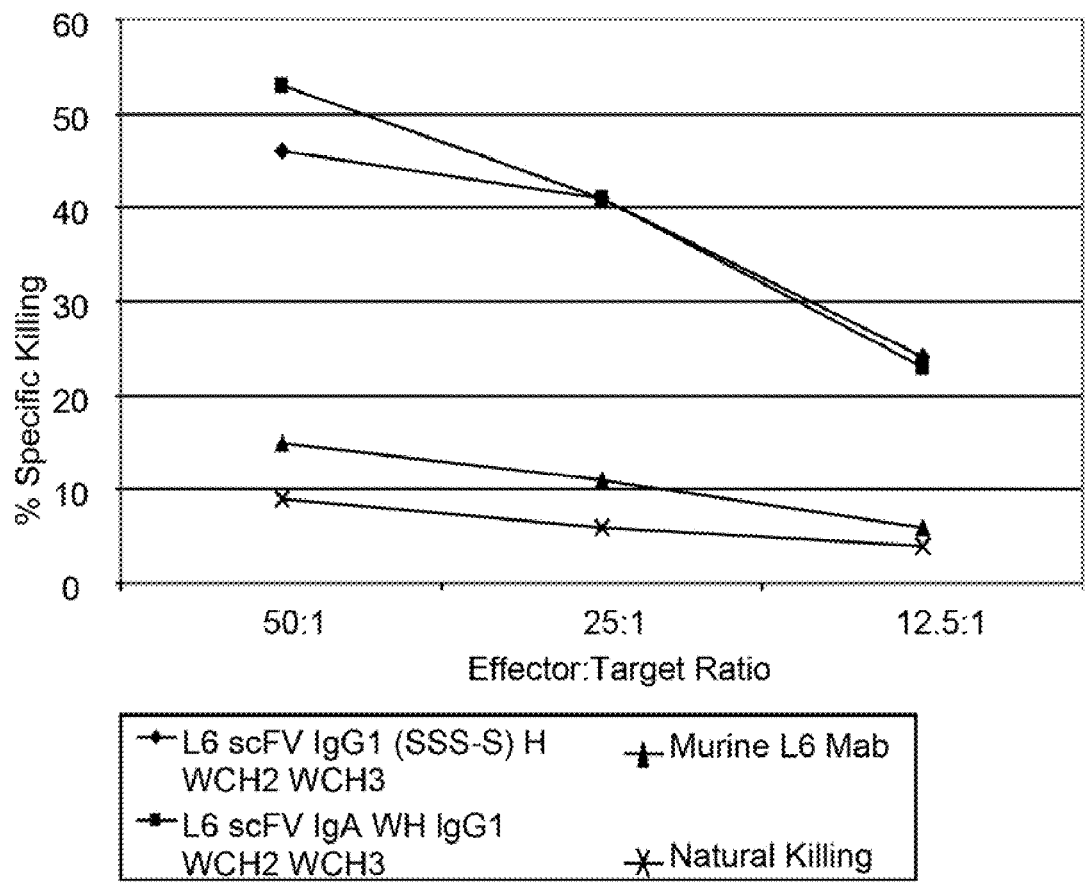
FIG. 20 shows antibody dependent cell-mediated cytotoxicity activity of L6 ScFv-Ig fusion proteins.

In addition to the scFv-Ig fusion protein already described, G28-1 (anti-CD37) scFv-Ig fusion proteins were prepared essentially as described in Examples 1 and 5. The variable regions of the heavy and light chains were cloned according to methods known in the art. ADCC activity of 2H7-MHWTG1C, 2H7-IgAHWTG1C, G28-1-MHWTG1C, G28-1 IgAHWTG1C, HD37-MHWTG1C, and HD37-IgAHWTG1C was determined according to methods described above (see Example 2). Results are presented in FIG. 19. ADCC activity of L6scFv-IgAHWTG1C and L6scFv-IgMHWTG1C was measured using the 2981 human lung carcinoma cell line. The results are presented in FIG. 20. The murine L6 monoclonal antibody is known not to exhibit ADCC activity.

Figure 21:
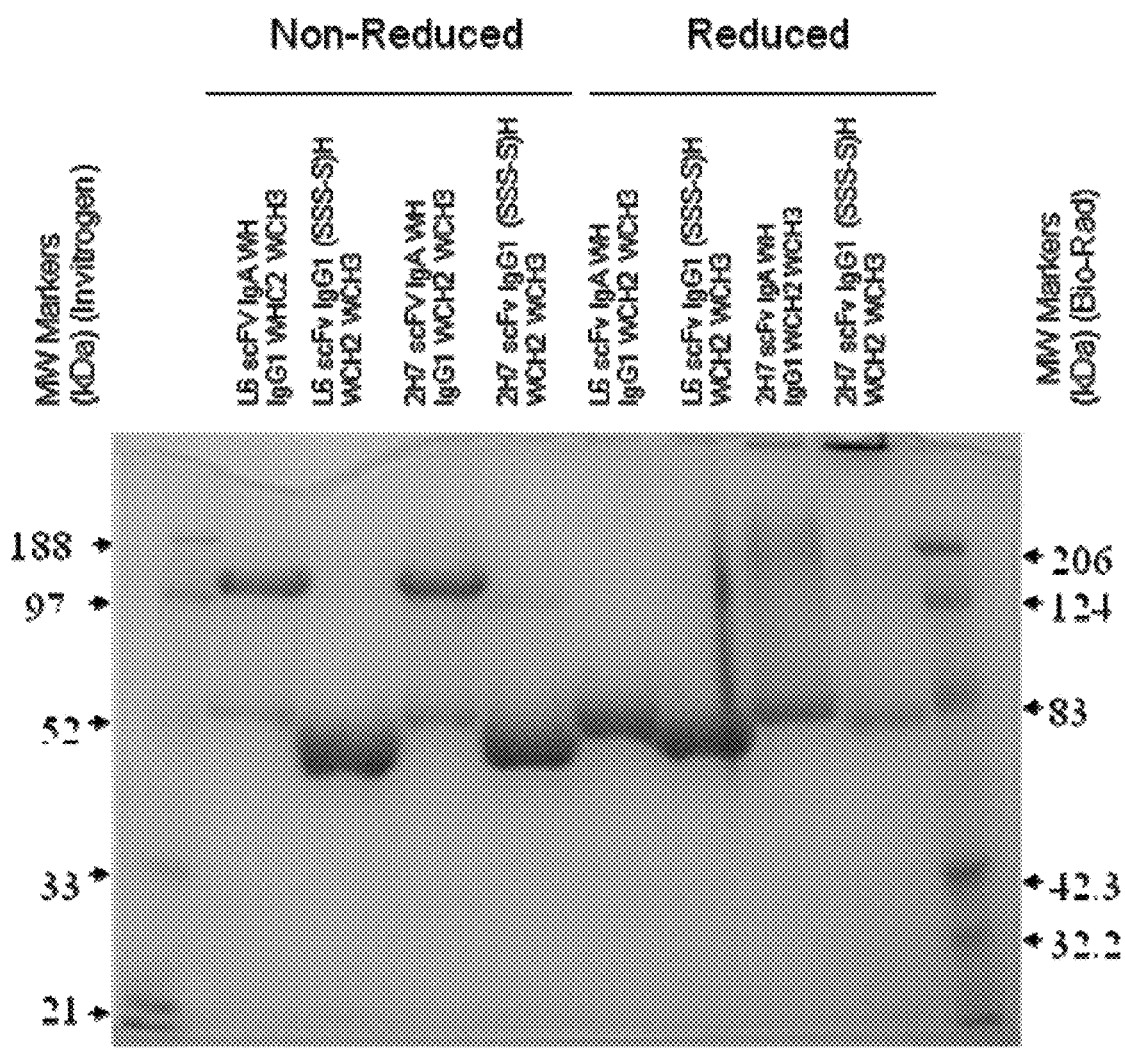
FIG. 21 shows SDS-PAGE analysis of L6 ScFv-Ig and 2H7 ScFv-Ig fusion proteins.
Figure 22:
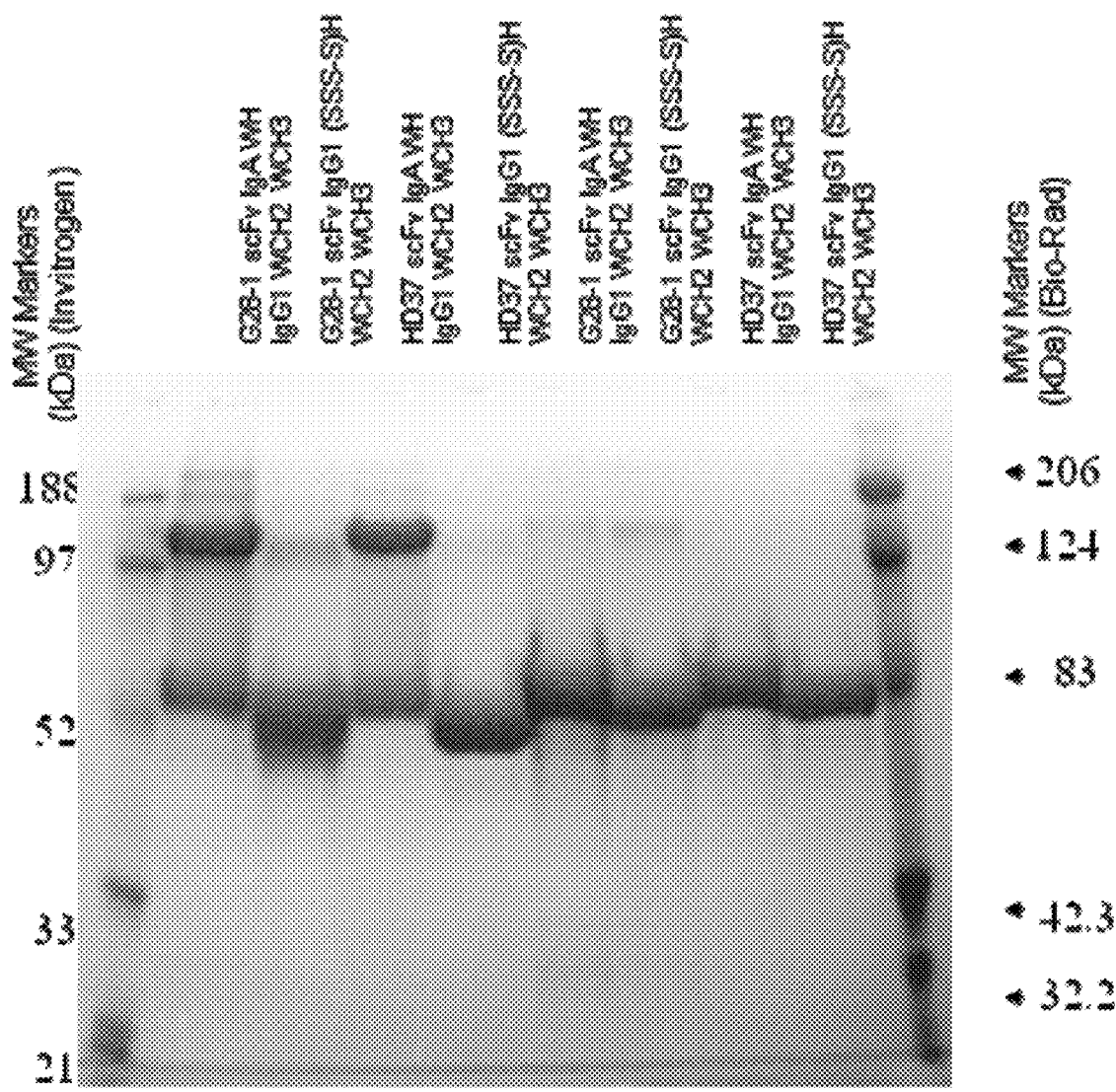
FIG. 22 shows SDS-PAGE analysis of G28-1 ScFv-Ig and HD37 ScFv-Ig fusion proteins.

The purified proteins were analyzed by SDS-PAGE under reducing and non-reducing conditions. Samples were prepared and gels run essentially as described in Examples 2 and 5. The results for the L6 and 2H7 scFv-Ig fusion proteins are presented in FIG. 21 and the results for the G28-1 and HD37 scFv-Ig fusion proteins are presented in FIG. 22.

Example 10

Construction and Expression of Anti-CD20 scFv-Llama Ig Fusion Proteins

This Example illustrates the cloning of llama IgG1, IgG2, and IgG3 constant region domains and the construction of immunoglobulin fusion proteins with each of the three constant regions and anti-CD20 scFv.

The constant regions of llama IgG1, IgG2, and IgG3 immunoglobulins were cloned and inserted into mammalian vector constructs containing an anti-CD20 single chain Fv, 2H7 scFv. Total RNA was isolated from peripheral blood mononuclear cells (PBMC) from llama blood (Triple J Farms, Bellingham, Wash.) by lysing the lymphocytes in TRIzol® (Invitrogen Life Technologies, Carlsbad, Calif.) according to the manufacturer's instructions. One microgram (1 µg) of total RNA was used as template to prepare cDNA by reverse transcription. The RNA and 200 ng random primers were combined and denatured at 72° C. for 10 minutes prior to addition of enzyme. Superscript II reverse transcriptase (Invitrogen Life Technologies) was added to the RNA plus primer mixture in a total volume of 25 µl in the presence of 5× second strand buffer and 0.1 M DTT provided with the enzyme. The reverse transcription reaction was allowed to proceed at 42° C. for one hour. The cDNA was amplified by PCR using sequence specific primers. The 5' primers were designed according to published sequences for the $V_{HH}$ and $V_H$ domains of camelids. The 3' primer, which was used to amplify all three isotypes, was designed using mammalian CH3 domain sequences as a guide. The following specific primers were used. The BcI and XbaI sites are indicated by underlined italicized sequences.

```
5' primer for llama IgG1 constant region
LLG1-5'bgl:
                                                        (SEQ ID NO: 542)
    5'-gtt gtt gat caa gaa cca cat gga gga tgc acg tg-3'

5' primer for llama IgG2 constant region
LLG2-5'bgl:
                                                        (SEQ ID NO: 543)
    5'-gtt gtt gat caa gaa ccc aag aca cca aaa cc-3'

5' primer for llama IgG3 constant region
LLG3-5'bgl:
                                                        (SEQ ID NO: 544)
    5'-gtt gtt gat caa gcg cac cac agc gaa gac ccc-3'
```

```
3' primer for llama IgG1, IgG2, and IgG3 constant regions
    LLG123-3'X:
                                                    (SEQ ID NO: 545)
    5'-gtt gtt tct aga tta cta ttt acc cga aga ctg ggt gat gga-3'
```

PCR fragments of the expected size were cloned into TOPO® cloning vectors (Invitrogen Life Technologies) and then were sequenced. The sense sequencing primer, LLseqsense, had the sequence 5'-ctg aga tcg agt tca gct g-3' (SEQ ID NO:546), and the antisense primer, LLseqAS, had the sequence 5'-cct cct ttg gct ttg tct c-3' (SEQ ID NO:547). Sequencing was performed as described in Example 1. FIG. 23 compares the amino acid sequence of the three isotype llama constant regions containing the hinge, CH2, and CH3 domains with the amino acid sequence of human IgG1 hinge, CH2, and CH3 domains.

After verifying the sequence, the amplified PCR products were digested with restriction enzymes BclI and XbaI to create compatible restriction sites. The digested fragments were then gel-purified, and the DNA was eluted using a QIAquick Gel Extraction Kit (QIAGEN, Valencia, Calif.). The 2H7scFv-Ig pD18 mammalian expression vector construct (see Example 2) was digested with BclI and XbaI to remove the human IgG hinge, CH2, and CH3 domains. The pD18 vector is a modified derivative of pcDNA3 that contains an attenuated DHFR gene, which serves as a selectable marker for mammalian expression (Hayden et al., *Tissue Antigens* 48:242-54 (1996)). The purified llama IgG1, IgG2, and IgG3 constant region PCR products were ligated by T4 DNA ligase (Roche Molecular Biochemicals, Indianapolis, Ind.) into the double-digested 2H7 scFv-pD18 vector at room temperature overnight according to the manufacturer's instructions. After ligation, the ligation products were transformed into *E. coli* DH5a bacteria (BD Biosciences, Palo Alto, Calif.) and plated according to standard molecular biology procedures and manufacturer's instructions. Isolated colonies were chosen to screen for transformants containing the correct inserts.

For expression of the encoded polypeptides, plasmid DNA from positive clones was transiently transfected into COS-7 cells using DEAE-dextran (Hayden et al., *Ther. Immunol.* 1:3-15 (1994)). COS-7 cells were seeded at approximately $3\times10^6$ cells per 150 mm plate and grown overnight until the cells were about 75% confluent. Cells were then washed once with serum-free DMEM (Invitrogen Life Technologies, Grand Island, N.Y.). Transfection supernatant (10 ml) containing 400 µg/ml DEAE-dextran, 0.1 mM chloroquine, and 5 µg/ml of the DNA constructs were added to the cells, which were then incubated at 37° C. for 3-4 hrs. After incubation, cells were pulsed with 10 ml of 10% dimethyl sulfoxide (DMSO) in 1×PBS at room temperature for 2 minutes. Cells were then placed back into fully supplemented DMEM/10% FBS (1% L-glutamine, 1% penicillin/streptomycin, 1% sodium pyruvate, 1% MEM essential amino acids) (Invitrogen Life Technologies). After 24 hours, the media was replaced with serum-free fully supplemented DMEM (Invitrogen Life Technologies), and the cells were maintained up to 21 days with media changes every 3-4 days.

Ig-fusion proteins were purified by passing COS cell culture supernatants through Protein A Agarose (Repligen, Cambridge, Mass.) columns. After application of the culture supernatant, the Protein A columns were then washed with 1×PBS (Invitrogen Life Technologies). Bound Ig-fusion proteins were eluted with 0.1 M citric acid (pH 2.8), and the collected fractions were immediately neutralized with Tris base (pH 10.85). The fractions containing protein were identified by measuring the optical density ($A_{280}$) and then were pooled, dialyzed against 1×PBS, (Invitrogen Life Technologies) and filtered through a 0.2 µm filter.

Figure 24:
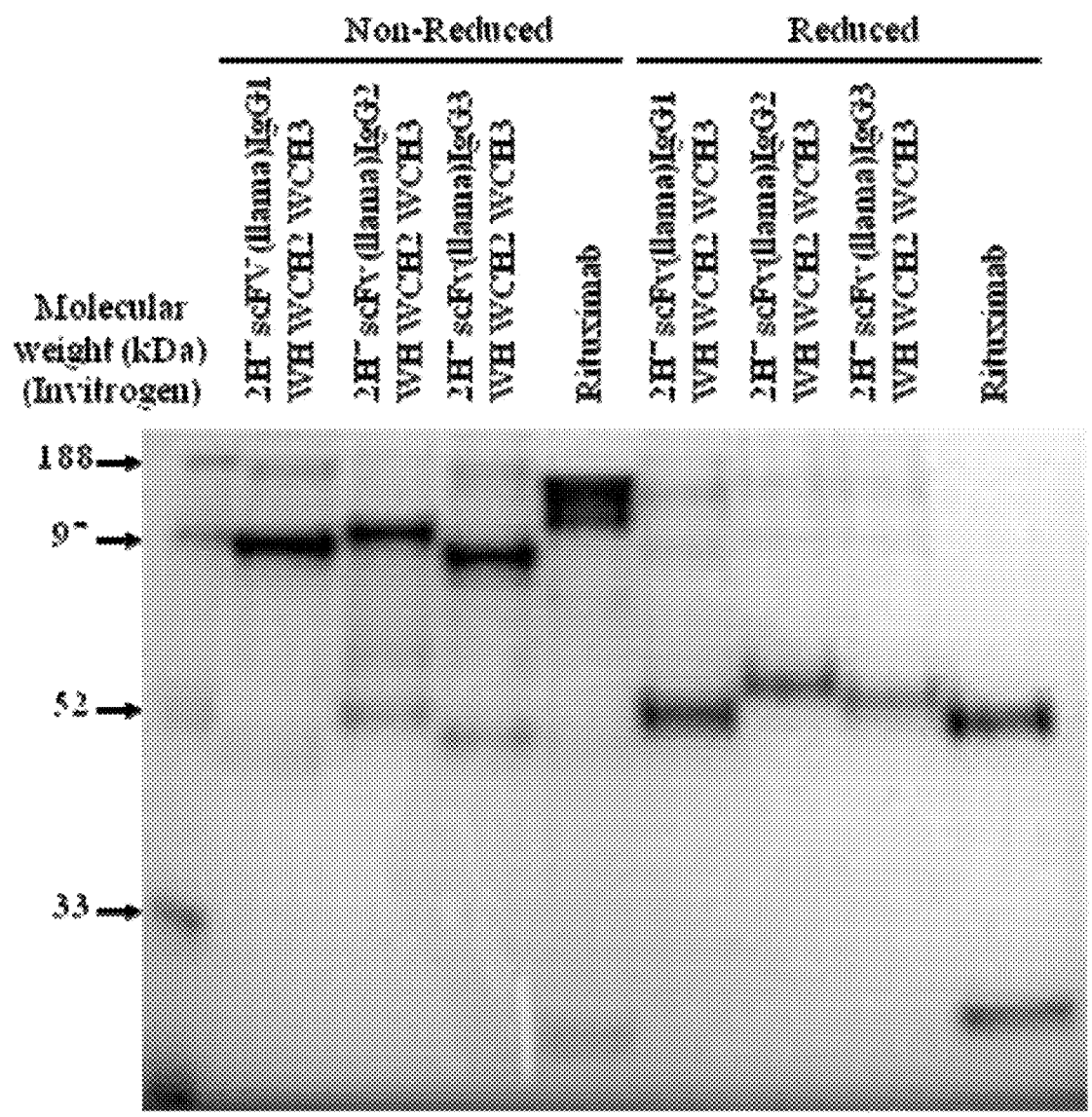
FIG. 24 illustrates migration of purified 2H7 scFv llama IgG fusion proteins in a 10% SDS polyacrylamide gel. Purified fusion proteins (5 μg per sample) were prepared in non-reducing sample buffer (lanes 2-5) and in reducing sample buffer (lanes 6-9). Lane 1: molecular weight markers (non-reduced); lanes 2 and 6: 2H7 scFv-llama IgG1 (SEQ ID NOS:21 and 22); Lanes 3 and 7: 2H7 scFv-llama IgG2 (SEQ ID NOS:23 and 24): lanes 4 and 8: 2H7 scFv-llama IgG3 (SEQ ID NOS:25 and 26); and Lanes 5 and 9: Rituximab (chimeric anti-CD20 antibody (human IgG1 constant region)).

The purified Ig-fusion proteins were analyzed by SDS-PAGE. Aliquots of 2H7 scFv-llama IgG1, 2H7 scFv-llama IgG2, 2H7 scFv-llama IgG3, and Rituxan® (Rituximab, anti-CD20 antibody, Genentech, Inc. and IDEC Pharmaceuticals Corp.) (5 µg protein) were combined with 25 µl 2× NuPAGE® SDS Sample Buffer (Invitrogen Life Technologies) (non-reduced samples). Samples of each protein were also prepared in reducing sample buffer containing 5% 2-mercaptoethanol (Sigma-Aldrich, St. Louis, Mo.). Molecular weight markers (Invitrogen Life Technologies) were applied to the gels in non-reducing buffer only. The proteins were fractionated on NuPAGE® 10% Bis-Tris gels (Invitrogen Life Technologies). After electrophoresis (approximately 1 hour), the gels were washed three times, five minutes each, with Distilled Water (Invitrogen Life Technologies) and then stained in 50 ml Bio-Safe Coommassie Stain (BioRad, Hercules, Calif.) overnight at room temperature. After a wash in Distilled Water, the gels were photographed. The migration pattern of each Ig-fusion protein is presented in FIG. 24.

Figure 25:
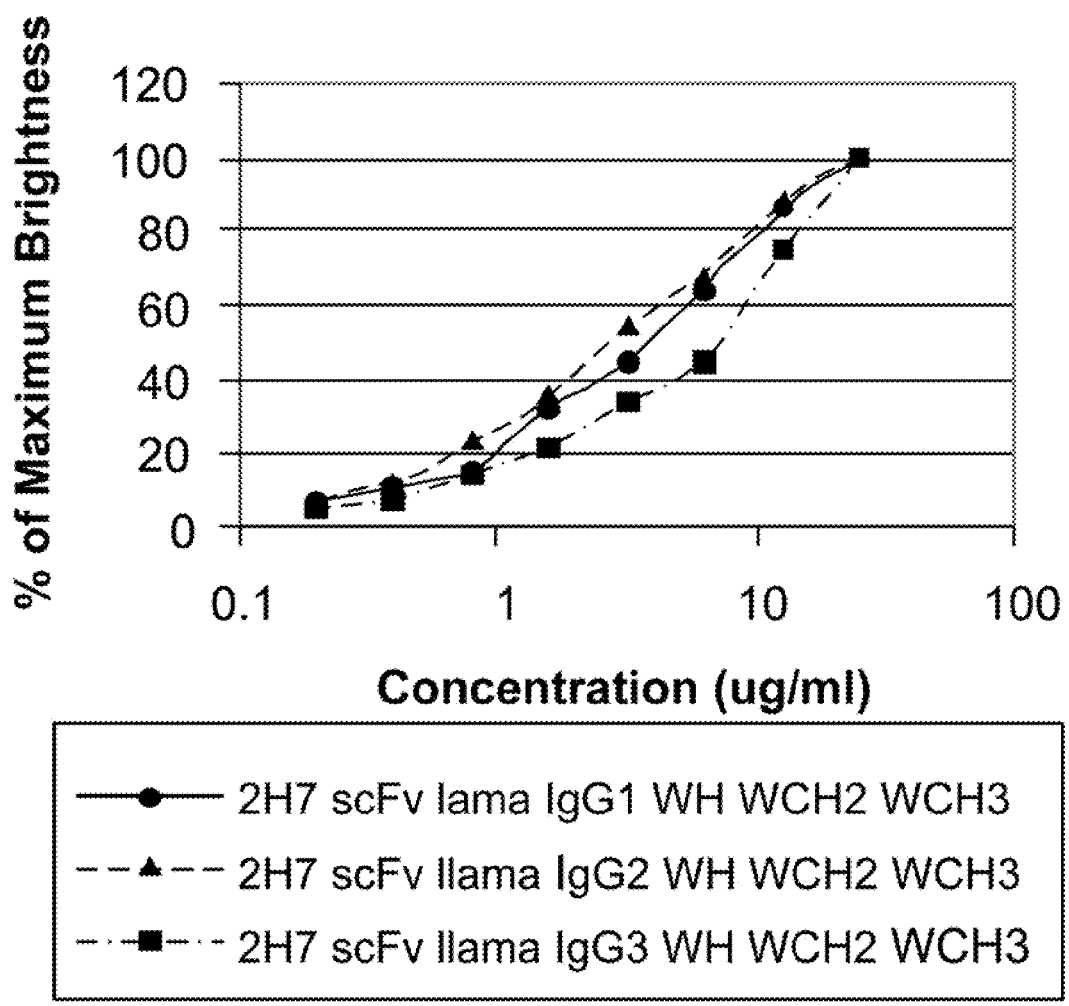
FIG. 25 shows binding of 2H7 scFv-llama IgG1 (SEQ ID NOS:21 and 22), 2H7 scFv-llama IgG2 (SEQ ID NOS:23 and 24), and 2H7 scFv-llama IgG3 (SEQ ID NOS:25 and 26) to CD20+CHO cells detected by flow immunocytofluorimetry.

The ability of the 2H7 scFv-llama Ig fusion proteins to bind to cells expressing CD20 was demonstrated by flow cytometry. Serial dilutions starting at 25 µg/ml of purified 2H7 scFv-llama IgG1, 2H7 scFv-llama IgG2, and 2H7 scFv-llama IgG3 were prepared and incubated with CD20-transfected (CD20+) CHO cells (from the laboratory of Dr. S. Skov, Institute of Medical Microbiology and Immunology, Copenhagen Denmark in 1% FBS 1×PBS media (Invitrogen Life Technologies) for one hour on ice. After the incubation, the cells were then centrifuged and washed with 1% FBS in 1×PBS. To detect bound 2H7 scFv-llama Ig, the cells were incubated for one hour on ice with fluorescein-conjugated goat anti-camelid IgG (heavy and light chain) (1:100) (Triple J Farms). The cells were then centrifuged and resuspended in 1% FBS-1×PBS and analyzed using a Coulter Epics XL cell sorter (Beckman Coulter, Miami, Fla.). The data (percent of maximum brightness) are presented in FIG. 25.

Example 11

Effector Function of Anti-CD20 scFv-Llama Ig Fusion Proteins

This Example demonstrates the ability of anti-CD20 llama IgG1, IgG2, and IgG3 fusion proteins to mediate complement dependent cytotoxicity (CDC) and antibody dependent cell-mediated cytotoxicity (ADCC).

Figure 26:
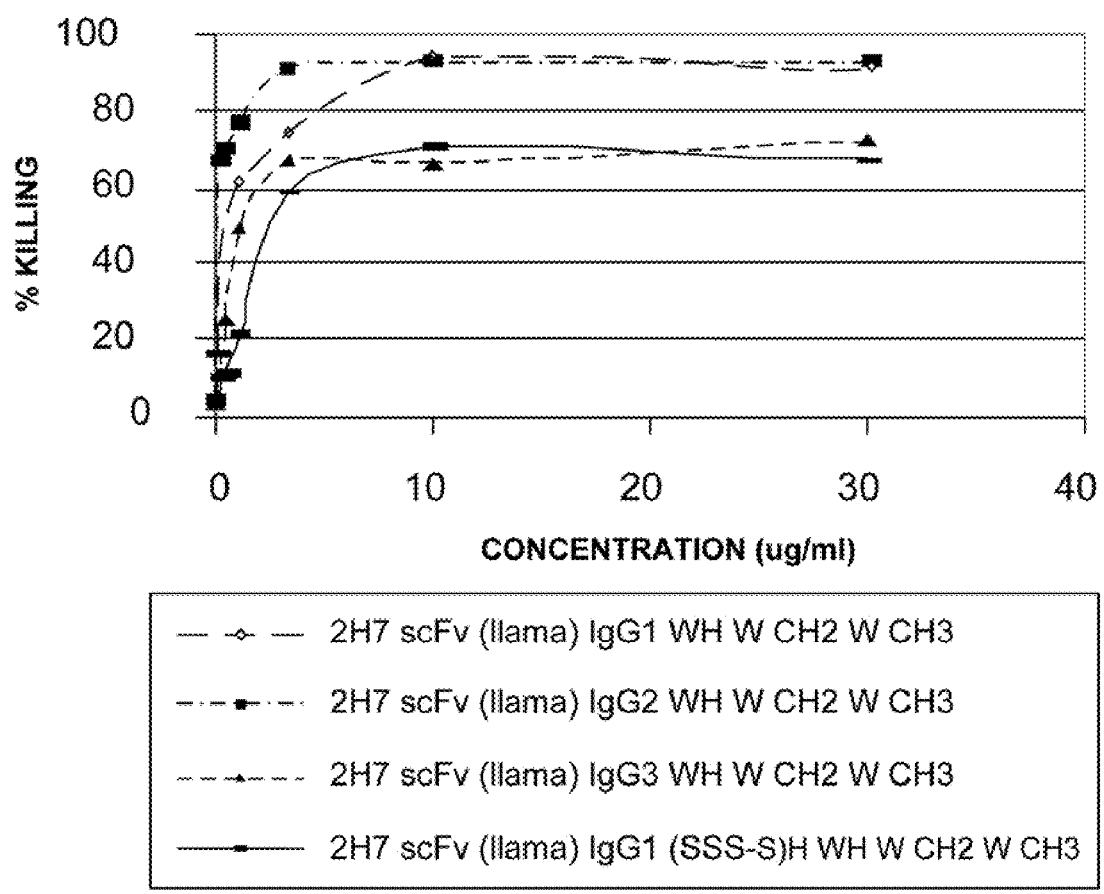
FIG. 26 depicts CDC activity of 2H7 scFv llama IgG fusion proteins, 2H7 scFv-llama IgG1 (SEQ ID NO:22), 2H7 scFv-llama IgG2 (SEQ ID NO:24), and 2H7 scFv-llama IgG3 (SEQ ID NO:26), and 2H7 scFv human IgG1 (2H7 scFv IgG WTH WTCH2CH3) (SEQ ID NO:28) against BJAB cells in the presence of rabbit complement. Rituximab was included as a control.

The ability of the 2H7 scFv-llama IgG fusion proteins to kill CD20 positive cells in the presence of complement was tested using the BJAB human B cell line. Rabbit complement was obtained from 3-4 week old rabbits (Pel-Freez, Brown Deer, Wis.). BJAB cells ($2\times10^6$ cells/ml) were combined with rabbit complement (final dilution 1:10) and purified 2H7 Ig fusion proteins. 2H7 scFv-llama IgG1, 2H7 scFv-llama IgG2, 2H7 scFv-llama IgG3, and 2H7 scFv-human IgG1 wild type hinge-CH2-CH3) (Example 1) were added at 1:3 serial dilutions beginning at a concentration of 30 µg/ml. After one hour at 37° C., cell viability was determined by counting live and dead cells by trypan blue exclusion (0.4%) (Invitrogen Life Technologies) using a hemacytometer (Bright-line, Horsham, Pa.). The percent killing was calculated by dividing the number of dead cells by the number of total cells (dead+live cells). The data presented in FIG. 26 show that all Ig fusion proteins had CDC activity.

Figure 27:
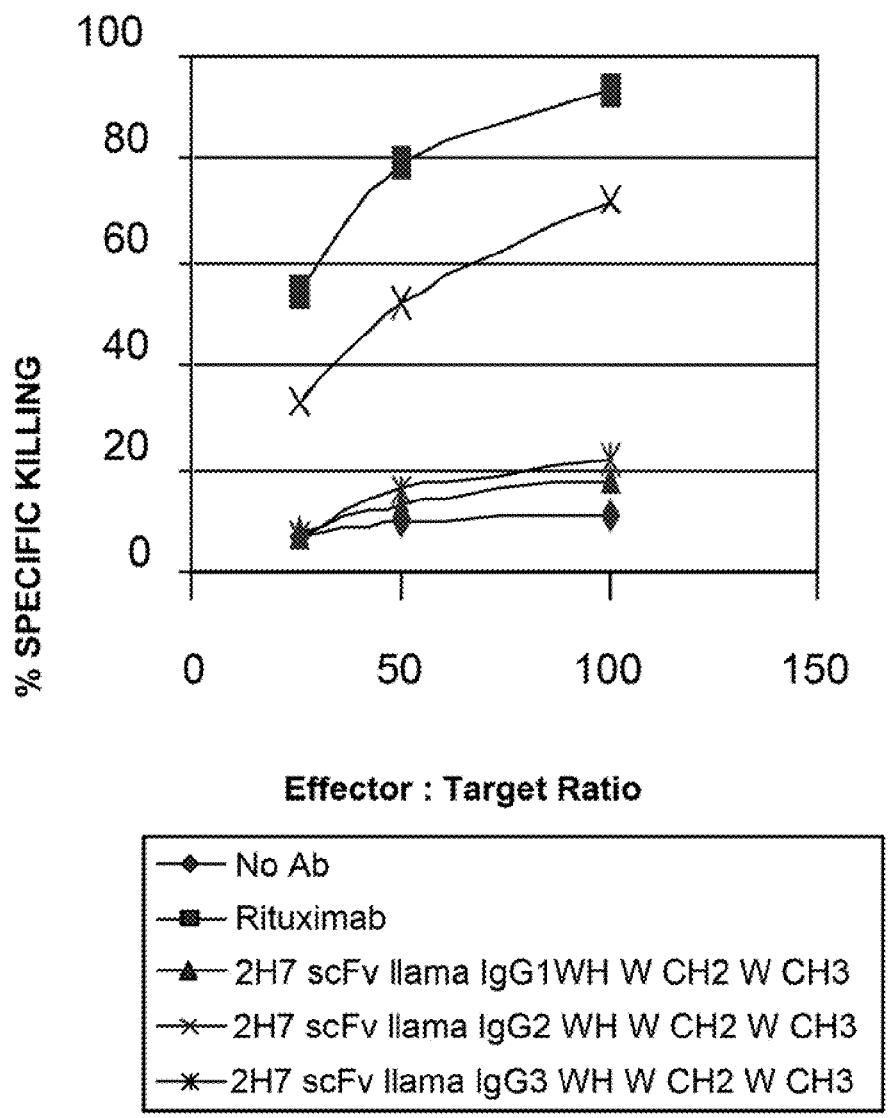
FIG. 27 shows antibody dependent cell-mediated cytotoxicity activity of 2H7 scFv llama IgG fusion proteins, 2H7 scFv-llama IgG1 (SEQ ID NO:22), 2H7 scFv-llama IgG2 (SEQ ID NO:24), and 2H7 scFv-llama IgG3 (SEQ ID NO:26). Effector cells (human PBMC) were combined with target cells (BJAB cells) at three different ratios, 1:25, 1:50, and 1:100. Rituximab was included as a control. Each data point represents three separate measurements.

The ADCC activity of the 2H7 scFv-llama IgG fusion proteins was determined using BJAB cells as target cells and human or llama peripheral blood mononuclear cells (PBMC) as effector cells. BJAB cells were pre-incubated for approximately 2 hours with $^{51}$Cr (100 µCi) (Amersham Biosciences, Piscataway, N.J.) in fully supplemented IMDM (Invitrogen Life Technologies) containing 15% FBS. The cells were mixed intermittently during the pre-incubation period. Fresh, resting human PBMC were purified from whole blood using Lymphocyte Separation Media (LSM) (ICN Pharmaceuticals, New York, N.Y.). PBMC were combined with labeled BJAB cells (5×10$^4$ cells per well of 96 well tissue culture plate) at ratios of 25:1, 50:1, and 100:1. To each combination was added 10 µg/ml of purified 2H7 scFv-llama IgG1, 2H7 scFv-llama IgG2, 2H7 scFv-llama IgG3, Rituximab, or no anti-CD20 antibody. The mixtures were incubated for 6 hours at 37° C. Supernatant from each reaction containing $^{51}$Cr released from lysed cells was collected onto a LumaPlate-96 filter plate (Packard, Meriden, Conn.), which was dried overnight. The amount of $^{51}$Cr was measured by a TopCount NXT plate reader (Packard). FIG. 27 shows that the 2H7 scFv-llama IgG2 fusion protein was the most effective llama fusion protein in mediating ADCC. Each data point represents the average measurement of triplicate wells.

Figure 28:
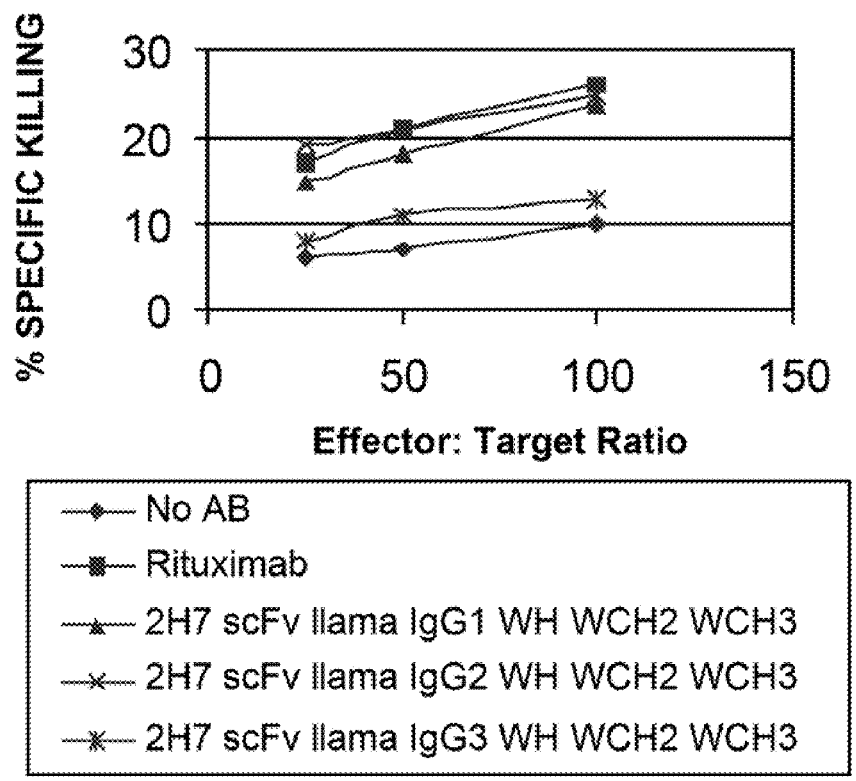
FIG. 28 shows antibody dependent cell-mediated cytotoxicity activity of 2H7 scFv llama IgG fusion proteins, 2H7 scFv-llama IgG1 (SEQ ID NO:22), 2H7 scFv-llama IgG2 (SEQ ID NO:24), and 2H7 scFv-llama IgG3 (SEQ ID NO:26). Effector cells (llama PBMC) were combined with target cells (BJAB cells) at three different ratios, 1:25, 1:50, and 1:100. Rituximab was included as a control. Each data point represents three separate measurements.

ADCC activity was affected by the source of effector cells. Llama PBMC were isolated from llama blood (Triple J Farms) using LSM. Llama effector cells were added at the same ratios to BJAB target cells as described for the ADCC assay using human effector cells. The cells were combined with 10 µg/ml of purified 2H7 scFv-llama IgG1, 2H7 scFv-llama IgG2, 2H7 scFv-llama IgG3, Rituximab, or no anti-CD20 antibody. The results are presented in FIG. 28.

Example 12

Construction and Characterization of scFv Ig Fusion Proteins Expressed on the Cell Surface This Example describes a retroviral transfection system for ectopic surface expression of genetically engineered cell surface receptors composed of scFvs that bind costimulatory receptors. The Example also demonstrates the effector function of these various scFv Ig fusion proteins expressed on the surface of target cells.

The heavy and light chain variable regions were cloned from murine monoclonal antibodies specific for various costimulatory receptors, and single chain Fv constructs were prepared essentially as described in Example 1. Antibodies included 2H7, anti-human CD20; 40.2.220, anti-human CD40; 2E12, anti-human CD28; 10A8, anti-human CD152 (anti-CTLA-4); and 500A2, anti-murine CD3. The heavy chain and light chain variable regions of each antibody were cloned according to standard methods for cloning immunoglobulin genes and as described in Example 1. Single chain Fv constructs were prepared as described in Example 1 by inserting a nucleotide sequence encoding a (gly$_4$ser)$_3$ (SEQ ID NO:529) peptide linker between the VL region nucleotide sequence of 40.2.220, 2E12, 10A8, and 500A2, respectively (SEQ ID NOs:31, 37 and 43, respectively) and the VH region nucleotide sequence of 40.2.220, 2E12, 10A8, and 500A2, respectively (SEQ ID NOs:33, 39 and 45, respectively). The polypeptide sequence for VL of 40.2.220, 2E12, 10A8, and 500A2 are set forth in SEQ ID NOs:32, 38 and 44, respectively, and the polypeptide sequence for VH of 40.2.220, 2E12, 10A8, and 500A2 are set forth in SEQ ID NOs:30, 40 and 46, respectively. Each scFv polynucleotide (SEQ ID NOs:36, 42 and 47 for 40.2.220, 2E12, 10A8, and 500A2, respectively) was then fused to human IgG1 mutant hinge (CCC→SSS) and mutant CH2 (proline to serine mutation at residue 238 (238 numbering according to EU nomenclature, Ward et al., 1995 *Therap. Immunol.* 2:77-94; residue 251 according to Kabat et al.) and wild type CH3 domains according to the methods described in Example 5 and 11. Each scFv mutant IgG1 fusion polynucleotide sequence was then fused in frame to sequences encoding the transmembrane domain and cytoplasmic tail of human CD80 (SEQ ID NO:29), such that when the fusion protein was expressed in the transfected cell, CD80 provided an anchor for surface expression of the scFv Ig fusion protein. cDNAs encoding the scFv-IgG-CD80 fusion proteins (SEQ ID NOs:49, 51, 53 and 55 for 40.2.220-, 2E12-, 10A8-, and 500A2-scFv-IgG-CD80, respectively) were inserted into the retroviral vector pLNCX (BD Biosciences Clontech, Palo Alto, Calif.) according to standard molecular biology procedures and vendor instructions. The scFv-Ig-CD80 cDNA was inserted between the 5'LTR-neomycin resistance gene-CMV promoter sequences and the 3'LTR sequence. The retroviral constructs were transfected into Reh, an acute lymphocytic leukemia cell line (ATCC CRL-8286). Transfected cells were screened to select clones that were expressing scFv-Ig fusion proteins on the cell surface.

Figure 29:
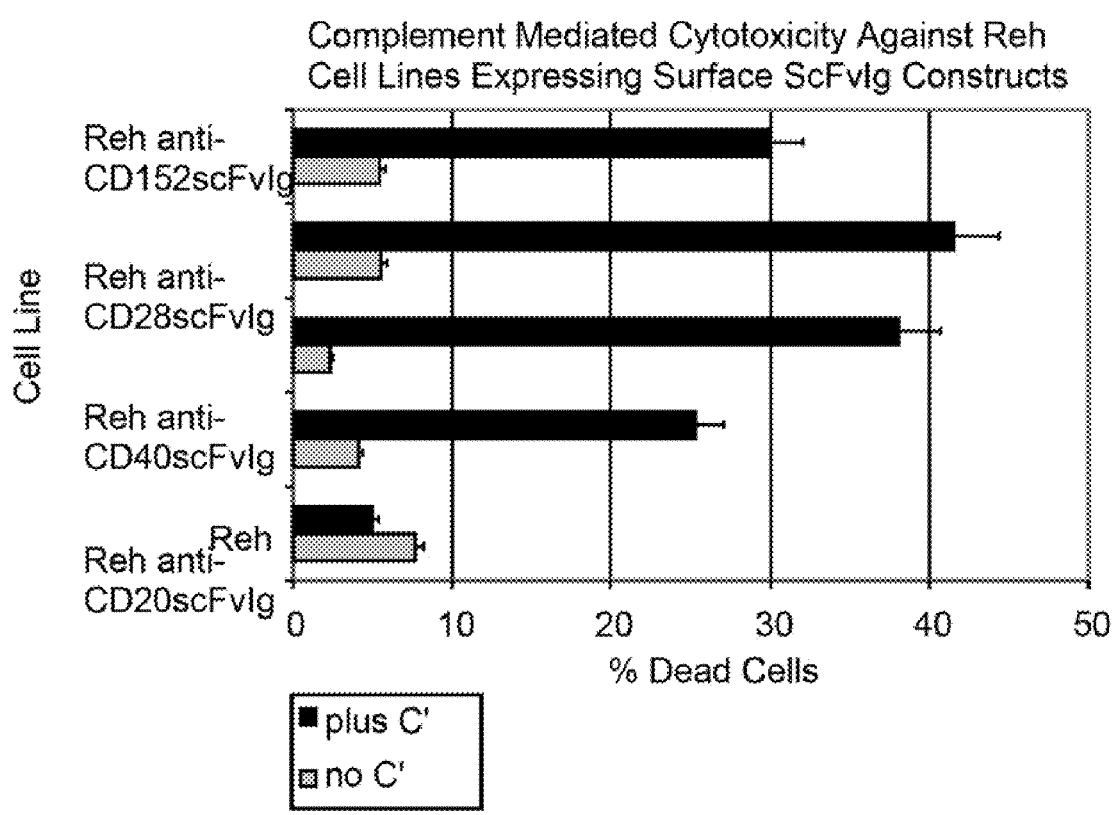
FIG. 29 depicts complement dependent cytotoxicity activity of Reh cells (acute lymphocytic leukemia) expressing scFv-Ig fusion proteins on the cell surface. Reh cells were transfected with constructs encoding scFv antibodies specific for human costimulatory molecules, CD152, CD28, CD40, and CD20, fused to human IgG1 wild-type hinge-CH2-CH3, which was fused to human CD80 transmembrane and cytoplasmic tail domains. Complement dependent cytotoxicity activity was measured in the presence and absence of rabbit complement (plus C' and no C', respectively). The data represent the average of duplicate samples. Reh anti-hCD152 scFvIg: Reh cells transfected with polynucleotide 10A8 scFv IgG MTH (SSS) MT CH2CH3 (SEQ ID NO:53); Reh anti-hCD28scFvIg: 2E12 scFv IgG MTH (SSS) MT CH2CH3 (SEQ ID NO:51); Reh anti-hCD40scFvIg: 4.2.220 scFv IgG MTH (SSS) MT CH2CH3 (SEQ ID NO:49); and Reh anti-hCD20scFvIg: 2H7 scFv IgG MTH (SSS) MT CH2CH3 (SEQ ID NOS:57 and 29).

CDC and ADCC assays were performed with the transfected Reh cells to determine if expression of the scFv-Ig polypeptides on the cell surface augmented effector cell function. Reh cells expressing anti-human CD152 scFv-mutant IgG-CD80 (SEQ ID NO:56); Reh anti-human CD28 scFv-mutant IgG-CD80 (SEQ ID NO:52);; Reh anti-human CD40 scFv-mutant IgG-CD80 (SEQ ID NO50:); Reh anti-human CD20 scFv-mutant IgG-CD80 (SEQ ID NO:_) were combined with human PBMC (see Example 11) and rabbit complement (10 µg/ml) for one hour at 37° C. Untransfected Reh cells were included as a control. Viability of the cells was determined by trypan blue exclusion, and the percent of killed cells was calculated (see Example 11). FIG. 29 shows the effectiveness of the scFv-IgG-CD80 fusion proteins when expressed on the cell surface of tumor cells to mediate complement dependent cytotoxicity.

Figure 30:
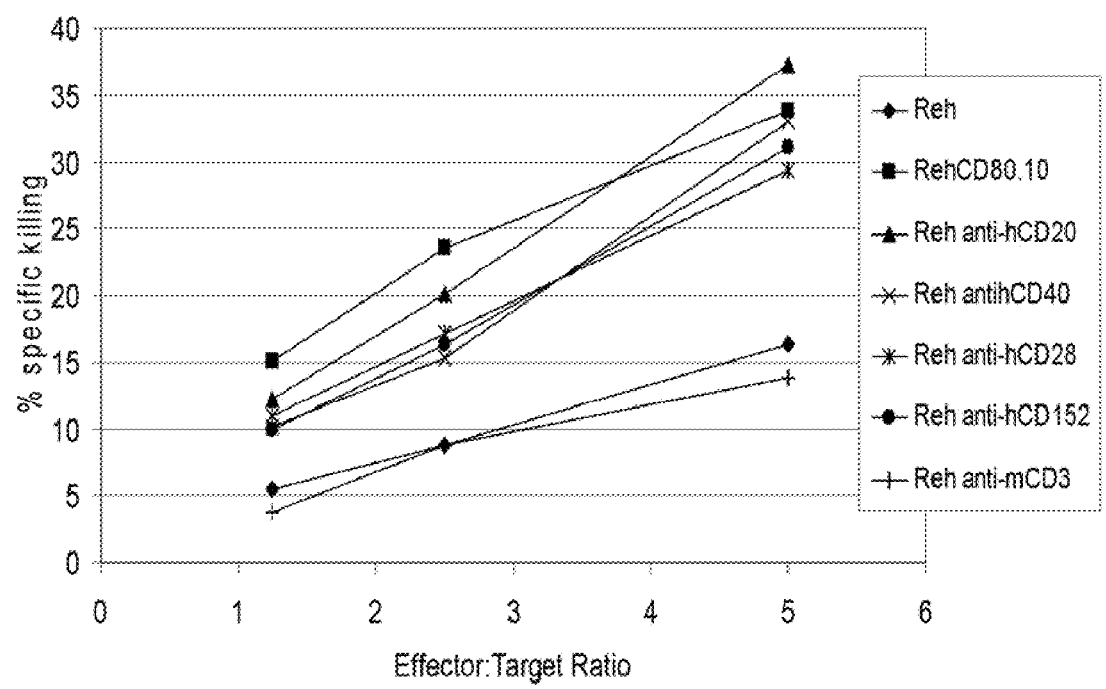
FIG. 30 presents antibody dependent cell-mediated cytotoxicity activity of Reh cells that were transfected with constructs encoding scFv antibodies specific for human costimulatory molecules, CD152, CD28, CD40, and CD20, as described for FIG. 29, and for murine CD3, fused to human mutant IgG1 hinge and mutant CH2 and wild type CH3 (Reh anti-mCD3scFv designating Reh cells transfected with polynucleotide 500A2 scFv IgG MTH (SSS) MTCH2WTCH3

The same transfected Reh cells tested in the CDC assay plus Reh cells transfected with the polynucleotide construct that encodes anti-murine CD3-scFv-Ig-CD80 (SEQ ID NO:110) were analyzed for ADCC activity (see Example 11). Untransfected and transfected Reh cells were pre-labeled with $^{51}$Cr (100 µCi) (Amersham) for two hours at 37° C. Human PBMC served as effector cells and were added to the Reh target cells (5×10$^4$ cells per well of 96 well plate) at ratios of 5:1, 2.5:1, and 1.25:1. After five hours at 37° C., culture supernatants were harvested and analyzed as described in Example 11. Percent specific killing was calculated according to the following equation: ((experiment release minus spontaneous release)/(maximum release minus spontaneous release))×100. The data are presented in FIG. 30. Each data point represents the average of quadruplicate samples.

Using the same procedures described above, the same results with other binding domains were obtained using the following monoclonal antibodies monoclonal antibodies as sources of sFv: for CD20, 1F5 (Genbank AY 058907 and AY058906); for CD40, 2.36 and G28.5; for CD28, 9.3.

Cell surface expression of antibody binding domains is accomplished by fusing antibody scFvs to IgA hinge and constant regions and IgE hinge-acting region, i.e., IgE CH2, and constant regions. Polynucleotides encoding an anti-4-1BB scFv, 5B9 (anti-human 4-1BB) scFv, and 2e12 (anti-human CD40) fused to IgAH IgA T4 (four terminal CH3 residues deleted) fused to the CD80 transmembrane and cytoplasmic domains and IgE Fc regions are shown in SEQ ID NOs:177, 181, 179 and 183. The encoded polypeptides are shown in SEQ ID NOs:178, 182, 180 and 184.

Example 13

Construction and Sequence of Human Ig Hinge-CH2-CH3 Mutants and 2H7 Variable Region Mutants This Example describes construction of scFv fusion proteins containing mutant human IgG1 and IgA constant regions. This Example also describes construction of a 2H7 scFv mutant with a single point mutation in the variable heavy chain region. Mutations were introduced into variable and constant region domains according to methods described herein and known in the molecular biology arts. FIG. 31 presents nomenclature for the Ig constant region constructs.

The human IgG1 hinge region of the 2H7 scFv human IgG1 hinge-CH2-CH3 fusion proteins was mutated to substitute cysteine residues that in a whole immunoglobulin are involved in forming disulfide bonds between two heavy chain molecules. One mutant, 2H7 scFv fused to a human IgG1 hinge region in which all three cysteine residues were mutated to serine residues (MTH (SSS)), was prepared as described in Example 5 (designated in Example 5 as CytoxB-MHWTG1C (includes wild type IgG1 CH2 and CH3 domains)) (now referred to as 2H7 scFv MTH (SSS) WTCH2CH3) and comprises the polynucleotide sequence SEQ ID NO:57 encoding the polypeptide as set forth in SEQ ID NO:58. The polynucleotide sequence encoding this mutant (SEQ ID NO:57) was used as a template to create mutant hinge regions in which the first two cysteine residues were substituted with serine residues (IgG MTH (SSC)). An oligonucleotide was designed to substitute the third serine residue with a cysteine and had the following sequence: 5'-gtt gtt gat cag gag ccc aaa tct tct gac aaa act cac aca tct cca ccg tgc cca gca cct g-3' (HuIgGMHncs3, SEQ ID NO:548). A second mutant was prepared in which the mutant hinge had serine residues substituting the first and third cysteine residues (IgG MTH (SCS)). The sequence of the oligonucleotide to create this mutant was as follows: 5'-gtt gtt gat cag gag ccc aaa tct tct gac aaa act cac aca tgc cca ccg-3' (HuIgGMHncs2, SEQ ID NO:549). A third mutant was prepared with cysteine residues substituted at the second and third positions (IgG MTH (CSS)), also using the IgG MTH (SSS) mutant as template, and an oligonucleotide having the sequence, 5'-gtt gtt gat cag gag ccc aaa tct tgt gac aaa act cac-3' (HuIgGMHncs1, SEQ ID NO:550).

The oligonucleotides introducing the mutations into the hinge region were combined with template and a 3' oligonucleotide containing an XbaI site (underlined and italicized) (5'-gtt gtt tctaga tca ttt acc cgg aga cag gga gag gct ctt ctg cgt gta g-3' (SEQ ID NO:551)) to amplify the mutant hinge-wild type (WT) CH2-CH3 sequences by PCR. The IgG MTH CSS and IgG MTH SCS mutant sequences were amplified for 25 cycles with a denaturation profile of 94° C., annealing at 52° C. for 30 seconds, and extension at 72° C. for 30 seconds. The IgG MTH SSC mutant sequence was amplified under slightly different conditions: denaturation profile of 94° C., annealing at 45° C. for 30 seconds, and extension at 72° C. for 45 seconds. The amplified polynucleotides were inserted into the TOPO® cloning vector (Invitrogen Life Technologies) and then were sequenced as described in Example 1 to confirm the presence of the mutation. pD18 vector containing 2H7 scFv was digested to remove the constant region sequences essentially as described in Example 10. The mutant hinge-wild type CH2-CH3 regions were inserted in frame into the digested vector DNA to obtain vectors comprising 2H7 scFv MTH (CSS) WTCH2CH3 encoding DNA (SEQ ID NO:134); 2H7 scFv MTH (SCS) WTCH2CH3 encoding DNA (SEQ ID NO:136); and 2H7 scFv MTH (SSC) WTCH2CH3 encoding DNA (SEQ ID NO:138).

A mutation of leucine to serine at position 11 in the first framework region of the heavy chain variable region (numbering according to Kabat et al., *Sequences of Proteins of Immunological Interest*, 5th ed. Bethesda, Md.: Public Health Service, National Institutes of Health (1991)) was introduced into the 2H7 scFv MTH (SSS) WTCH2CH3 fusion protein (SEQ ID NO:58). The wild type leucine residue was substituted with serine by site-directed mutagenesis using the oligonucleotide Vhser11: 5'-gga ggt ggg agc tct cag gct tat cta cag cag tct ggg gct gag tcg gtg agg cc-3' (SEQ ID NO:552) (this sequence, or an amino acid sequence that it encodes, may be optionally excluded from particular claimed embodiments of the instant invention). The 3'-primer for PCR was huIgG1-3' having the sequence 5'-gtc tctaga cta tca ttt acc cgg aga cag-3' (SEQ ID NO:553) (XbaI site underlined and italicized). After PCR amplification, the fragments were inserted into the TOPO® cloning vector and sequenced to confirm the presence of the VH11 leucine to serine mutation. The 2H7 scFv-IgG MTH (SSS) WTCH2CH3 encoding DNA was shuttled into the PSL1180 cloning vector (Pharmacia Biotech, Inc., Piscataway, N.J.). The construct PSL1180-2H7 scFv-IgG MTH (SSS) WTCH2CH3 was digested with Sac and XbaI to remove the wild type VH domain and the hinge and CH2 and CH3 domains. The PCR product comprising the VH11 mutant was digested with Sac and XbaI and then inserted into the digested PSL1180 construct according to standard molecular biology procedures. The construct was then digested with Hind III and XbaI, and inserted into the mammalian expression vector pD18 (see methods described in Example 1 and Example 10). The mutant is designated 2H7 scFv VH11SER IgG MTH (SSS) WTCH2CH3 (FIG. 31). The polynucleotide sequence is provided in SEQ ID NO:369, and the encoded polypeptide sequence is provided in SEQ ID NO:370 (these sequences may be optionally excluded from particular claimed embodiments of the instant invention).

Four constructs containing IgA constant region domains were prepared. One construct contained wild type IgA hinge fused to human IgG1 CH2 and CH3 (IgAH IgG WTCH2CH3) (FIG. 31). Sequential PCR amplifications were performed to substitute the human IgG1 hinge of the 2H7 scFv construct with nucleotide sequences encoding the IgA hinge. The 5' oligonucleotide primer (huIgA/Gchim5) for the first PCR reaction had the sequence, 5'-cca tct ccc tca act cca cct acc cca tct ccc tca tgc gca cct gaa ctc ctg-3' (SEQ ID NO:554). The primer (huIgAhg-5') for the second PCR reaction to add more IgA specific hinge sequence and add a BclI restriction enzyme site (italicized and underlined) had the sequence, 5'-gtt gatcag cca gtt ccc tca act cca cct acc cca tct ccc caa ct-3' (SEQ ID NO:555). The 3' primer for both amplification steps was huIgG1-3' having the sequence, 5'-gtc tct aga cta tca ttt acc cgg aga cag-3' (SEQ ID NO:556). The sequence of the PCR product was confirmed by TOPO® cloning as described above. The gel-purified fragment was digested with BclI and XbaI and then inserted into the 2H7 scFv-pD18 vector that had been digested BclI and XbaI to remove all the IgG1 constant region domains. Ligation was performed as described in Example 10 to provide a mammalian expression vector comprising the nucleotide sequence (SEQ ID NO:59) encoding a 2H7 scFv IgA hinge-IgG1 CH2-CH3 polypeptide (SEQ ID NO:60).

A second pD18 mammalian expression vector was constructed that had a polynucleotide sequence (SEQ ID NO:61) that encoded a 2H7 scFv fused to wild type IgA hinge, CH2, and CH3 domains (SEQ ID NO:62). Human IgA constant regions sequences were obtained by using random primers to reverse transcribe total RNA isolated from human tonsil followed by PCR amplification of the cDNA using sequence specific primers, essentially as described in Example 10. Human IgA hinge-CH2-CH3 nucleotide sequence (SEQ ID NO:63) encoding the IgA-CH2-CH3 polypeptide (IgAH IgACH2CH3, FIG. 31) (SEQ ID NO:64) was amplified using the 5' oligonucleotide huIgAhg-5' (SEQ ID NO:555 and a 3' oligonucleotide huIgA3' having the sequence, 5'-gtt gtt tct aga tta tca gta gca ggt gcc gtc cac ctc cgc cat gac aac-3' (SEQ ID NO:557). Secretion of a 2H7-IgA hinge-IgA CH2-CH3 polypeptide from transfected mammalian cells required co-expression of human J chain that covalently binds to two IgA CH3 domains via disulfide bonds. Total RNA was isolated from tonsil B cells and was reversed transcribed to generate cDNA as described above. PCR amplification of the nucleotide sequence encoding the J chain was performed with J chain specific primers. The 5' PCR primer, HUJCH5n1, had the sequence, 5'-gtt gtt aga tct caa gaa gat gaa agg att gtt ctt-3' (SEQ ID NO:558), and sequence of the 3' primer, HUJCH3, was 5'-gtt gtt tct aga tta gtc agg ata gca ggc atc tgg-3' (SEQ ID NO:559). The cDNA was cloned into TOPO® for sequencing as described in Example 10. J chain encoding cDNA (SEQ ID NO:65) was then inserted into pD18 and pcDNA3-Hygro (+) (Invitrogen Life Technology) vectors for co-transfection with 2H7 scFv IgA hinge-CH2-CH3 constructs. The J chain has the predicted amino acid sequence set forth in SEQ ID NO:66.

Secretion of an scFv IgA constant region construct in the absence of J chain was accomplished by engineering a truncated CH3 domain with a deletion of the four carboxy terminal amino acids (GTCY, SEQ ID NO:67) (IgAH IgA-T4, FIG. 31), which include a cysteine residue that forms a disulfide bond with the J chain. The IgA hinge-CH2-CH3 nucleotide sequence containing the deletion in CH3 (SEQ ID NO:68) was prepared using a 5' PCR primer (huIgAhg-5') having the sequence 5'-gtt gtt<u>*gatcag*</u> cca gtt ccc tca act cca cct acc cca tct ccc tca act-3' (SEQ ID NO:561) (BclI site is underlined and italicized), and a 3' PCR primer (HUIGA3T1) having the sequence 5'-gtt gtt tct aga tta tca gtc cac ctc cgc cat gac aac aga cac-3' (SEQ ID NO:562). This mutated IgA constant region nucleotide sequence was inserted into a 2H7 scFv pD18 vector as described for the generation of the previous 2H7 scFv-Ig constructs (see Example 1 and this Example) that comprises the polynucleotide sequence (SEQ ID NO:70) encoding a 2H7 IgAH IgA-T4 polynucleotide (SEQ ID NO:71).

A fourth construct was prepared that encoded a 2H7 scFv-IgA constant region fusion protein with a deletion of 14 additional amino acids, most of which are hydrophobic residues, from the carboxy terminus of IgA CH3. The 2H7 scFv-IgAH IgA-T4 encoding polynucleotide was used as template to engineer a deletion of the nucleotide sequence encoding PTHVNVSVVMAEVD (SEQ ID NO:72). The 5' oligonucleotide primer had the sequence 5'-gtt gtt<u>*gatcag*</u> cca gtt ccc tca act cca cct acc cca tct ccc tca act-3' (SEQ ID NO:564) (BclI site shown as underlined and italicized). The 3' oligonucleotide sequence was 5'-gtt gtt tct aga tta tca ttt acc cgc caa gcg gtc gat ggt ctt-3' (SEQ ID NO:565). The deleted IgA CH3 region was amplified by using the above oligonucleotides to amplify the IgA constant region from RNA isolated from human tonsil such that the cDNA contained the deleted carboxyl terminal encoding region for the 18 amino acids. The IgAH IgA-T18 constant region was inserted into a 2H7 scFv pD18 vector that comprises the polynucleotide sequence (SEQ ID NO:75) encoding a 2H7 IgAH IgA-T18 polynucleotide (SEQ ID NO:76) as described above.

Example 14

Effector Function of CTLA-4 IgG Fusion Proteins

The Example compares the effector functions of CTLA-4 Ig fusion proteins in CDC and ADCC assays.

Two CTLA-4 IgG fusion proteins were constructed. One fusion protein comprises the extracellular domain of CTLA-4 fused to human IgG1 wild type hinge, CH2, and CH3 domains and is designated CTLA-4 IgG WTH (CCC) WTCH2CH3 (SEQ ID NO78). A pD18 mammalian expression vector comprising a polynucleotide sequence encoding CTLA-4 IgG WTH (CCC) WTCH2CH3 (SEQ ID NO:77) was prepared by fusing in frame the nucleotide sequence encoding the extracellular domain of CTLA-4 (SEQ ID NO:83) (see U.S. Pat. No. 5,844,095) to the nucleotide sequence encoding IgG WTH (CCC) WTCH2CH3 (SEQ ID NO:1) according to the methods described in Examples 1 and 10. The extracellular domain nucleotide sequence also comprises a BclI restriction enzyme site at the 3' end, and a leader peptide nucleotide sequence (SEQ ID NO:79) that encodes an oncoM leader peptide (SEQ ID NO:80). A second CTLA-4 IgG fusion protein, designated CTLA-4 IgG MTH (SSS) MTCH2WTCH3, contained the extracellular domain of CTLA-4 (plus the oncoM leader peptide sequence) fused to a mutant IgG hinge in which all three cysteine residues were replaced with serine residues. The hinge region was fused to a mutant IgG1 CH2 domain that had a mutation at isotype position 238 (EU numbering, Ward et al., supra, (position 251 using numbering according to Kabat et al., supra; position 209 where numbering commences with first residue of IgG1 CH1; i.e., PAPELLDGPS (SEQ ID NO:566) of wild type IgG1 CH2 is modified to PAPELLDGSS (SEQ ID NO:567)), which was fused to IgG1 wild type CH3 (U.S. Pat. No. 5,844, 095). The CTLA-4 IgG MTH (SSS) MTCH2WTCH3 polynucleotide comprises the nucleotide sequence in SEQ ID NO:85 and the deduced amino acid sequence comprises the sequence provided in SEQ ID NO:86. CTLA-4 fusion proteins were also prepared using CTLA-4 extracellular membrane encoding sequences without the leader peptide (SEQ ID NO:84).

To measure CDC activity, purified CTLA-4 IgG WTH (CCC) WTCH2CH3 (2 µg/ml) or CTLA-4 IgG MTH (SSS) MTCH2WTCH3 (2 µg/ml) was added to Reh cells (see Example 12) and to Reh cells transfected with the costimulatory molecule CD80 such that CD80 was expressed on the cell surface (Reh CD80.10; see Doty et al., 1998 *J. Immunol.* 161:2700; Doty et al., 1996 *J. Immunol.* 157:3270), in the presence or absence of rabbit complement (10 µg/ml). Purified CTLA Ig fusion proteins were prepared from culture supernatants of transiently transfected COS cells according to methods described in Example 10. The assays were performed essentially as described in Example 11 and 12. The data presented in FIG. 32 show that only CD80-transfected Reh cells were killed in the presence of complement and CTLA-4 IgG WTH (CCC) WTCH2CH3 fusion protein.

The purified CTLA-4 Ig fusion proteins were also tested in ADCC assays. Human PBMC, serving as effector cells, were added to Reh or Reh CD80.1 target cells at a ratio of 1.25:1, 2.5:1, 5.0:1, and 10:1. Cells were labeled and the assays performed essentially as described in Examples 11 and 12. The results are presented in FIG. 33. Each data point represents the average of four independent culture wells at each effector:target cell ratio. The data show that only CTLA-4 IgG WTH (CCC) WTCH2CH3 mediated significant ADCC of Reh CD80.10 cells.

Example 15

Effector Function of CTLA-4 IgA Fusion Proteins

CTLA-4 IgA fusion proteins are prepared as described for the IgG fusion proteins (see Examples 1, 13, and 14). CTLA-4 extracellular domain nucleotide sequence (SEQ ID NO:84) is fused in open reading frame to nucleotides encoding IgAH IgACH2CH3 (SEQ ID NO:63) to provide the nucleotide sequence (SEQ ID NO:87) encoding a CTLA-4 IgAH IgACH2CH3 fusion protein (SEQ ID NO:88). The fusion protein is transiently expressed in COS cells (see Example 10) or stably expressed in CHO cells (see Example 1). Secretion of the CTLA-4 IgAH IgACH2CH3 fusion protein requires co-transfection with a construct containing a polynucleotide sequence (SEQ ID NO:65) that encodes human J chain (SEQ ID NO:66). The CTLA-4 IgAH IgACH2CH3 fusion protein is isolated as described in Examples 10 and 14. To express a CTLA-4 IgA construct without the presence of J chain, a CTLA-4 IgAH IgA-T4 construct is prepared and transfected into mammalian cells. In a similar manner as described for the CTLA-4 extracellular fragment fused to wild type IgA hinge-CH2CH3, the CTLA-4 extracellular domain nucleotide sequence (SEQ ID NO:84) is fused in open reading frame to a nucleotide sequence (SEQ ID NO:68) encoding a IgAH IgA-T4 polypeptide (SEQ ID NO:69) to provide a nucleotide sequence comprising SEQ ID NO:89 encoding a CTLA-4 IgAH IgA-T4 polypeptide (SEQ ID NO:90). Effector function of each construct is evaluated by CDC and ADCC as described in Example 14.

Example 16

Binding of Anti-CD20 scFv Human Ig Fusion Proteins to CHO Cells Expressing CD20

This Example describes binding of 2H7 scFv Ig fusion proteins to CHO cells that express CD20. The analysis was performed by flow cytometry. Culture supernatants were collected from transiently transfected COS cells expressing 2H7 scFv IgG WTH (CCC) WTCH2CH3 (SEQ ID NO:28); 2H7 scFv IgG MTH (CSS) WTCH2CH3 (SEQ ID NO:135); 2H7 scFv IgG MTH (SCS) WTCH2CH3 (SEQ ID NO:137); and 2H7 scFv VHSER11 WTH WTCH2CH3, and two-fold serial dilutions were prepared. Serial two-fold dilutions of purified 2H7 scFv IgG MTH (SSC) WTCH2CH3 (SEQ ID NO:139) were prepared starting at a concentration of 5 µg/ml. The culture supernatants and purified fusion protein samples were incubated with (CD20+) CHO cells for one hour on ice. The cells were washed twice and then incubated with 1:100 FITC-conjugated goat anti-human IgG (CalTag) for 40 minutes. The unbound conjugate was then removed by washing the cells and flow cytometry analysis was performed using a Coulter Epics XL cell sorter. Results are presented in FIG. 34.

Example 17

Immunoblot Analysis of Anti-CD20 scFv Human IgG and IgA Fusion Proteins

This Example describes immunoblot analysis of 2H7 scFv IgG and 2H7 scFv IgA fusion proteins that were immunoprecipitated from transfected cell culture supernants.

COS cells were transiently transfected with plasmids comprising nucleotide sequences for 2H7 scFv IgG WTH (CCC) WTCH2CH3 (SEQ ID NO:28); 2H7 scFv IgG MTH (CSS) WTCH2CH3 (SEQ ID NO:135); 2H7 scFv IgG MTH (SCS) WTCH2CH3 (SEQ ID NO:137); 2H7 scFv IgA H IgG WTCH2CH3 (SEQ ID NO:60); and scFv IgG MTH (SSS) WTCH2CH3 (SEQ ID NO:58) essentially according to the method described in Example 10. Cells were also transfected with vector only. After 48-72 hours at 37° C., cell culture supernatants were harvested and combined with protein A-agarose beads (Repligen) for one hour at 4° C. The beads were centrifuged and washed several times in TNEN [20 mM Tris base, 100 mM NaCl, 1 mM EDTA, and 0.05% NP-40, pH 8.0). The immunoprecipitates were combined with 25 µl 2× NuPAGE® SDS Sample Buffer (Invitrogen Life Technologies) (non-reduced samples). The proteins were fractionated on NuPAGE® 10% Bis-Tris gels (Invitrogen Life Technologies). After electrophoresis (approximately 1 hour), the proteins were transferred from the gel onto a Immobilon P polyvinylidene fluoride (PVDF) membrane (Millipore, Bedford, Mass.) using a semi-dry blotter (Ellard Instrumentation, Monroe, Wash.). The PVDF membrane was blocked in PBS containing 5% nonfat milk and then probed with HRP-conjugated goat anti-human IgG (Fc specific) (CalTag). After washing the immunoblot several times in PBS, the blot was developed using ECL (Amersham Biosciences). The results are shown in FIG. 35.

Example 18

Binding of Anti-CD20 scFv Human IgA Fusion Proteins to CD20+CHO Cells

This Example describes flow immunocytofluorimetry analysis of binding of 2H7 scFv IgAH IgACH2CH3 (SEQ ID NO:62) and 2H7 scFv IgAH IgAT4 (SEQ ID NO:70) fusion proteins to (CD20+) CHO cells.

COS cells were transiently co-transfected as described in Example 10 with plasmid DNA comprising a polynucleotide sequence (SEQ ID NO:61) encoding 2H7 scFv IgAH IgACH2CH3 polypeptide (SEQ ID NO:62) and with a separate plasmid comprising a polynucleotide sequence (SEQ ID NO:65) encoding a human J chain polypeptide (SEQ ID NO:66). COS cells were also transfected with a polynucleotide sequence (SEQ ID NO:70) encoding a 2H7 scFv IgA fusion protein that had a deletion of four amino acids at the carboxy terminus of CH3 (2H7 scFv IgAH IgA-T4, SEQ ID NO:71). The transfections were performed as described in Example 10. Culture supernatants from transfected COS cells were combined with (CD20+) CHO cells (see Example 1) and incubated for one hour on ice. The cells were washed twice with PBS-2% FBS and then combined with FITC-conjugated goat anti-human IgA chain (CalTag) (1:100) for 40 minutes. The cells were again washed and then analyzed by flow cytometry using a Coulter Epics XL cell sorter. FIG. 36 shows that co-transfection with J chain was not required for secretion of 2H7 scFv IgAH IgAT4, the 2H7 IgA fusion protein with the truncated CH3 carboxy end (SEQ ID NO:71).

Example 19

Effector Function of Anti-CD20 scFv Human IgA Fusion Proteins

This Example illustrates ADCC activity of 2H7 IgG and IgA fusion proteins against cells that express CD20. BJAB cells were prelabeled with $^{51}$Cr (100 µCi) (Amersham) for two hours at 37° C. Effector cells were obtained from fresh, resting human whole blood, which was diluted in an equal volume of Alsever's solution to prevent coagulation. 2H7 scFv IgG MTH (SSS) WTCH2CH3 (SEQ ID NO:58); 2H7 scFv IgG MTH (SCS) WTCH2CH3 (SEQ ID NO:137); 2H7 scFv IgG WTH (CCC) WTCH2CH3 (SEQ ID NO:28); and 2H7 scFv IgAH IgACH2CH3 (SEQ ID NO:62) fusion proteins were purified from transiently transfected COS cell supernatants (100-200 ml) by protein A chromatography as described in Example 10. COS cells transfected with the plasmid encoding 2H7 scFv IgAH IgACH2CH3 were co-transfected with a plasmid encoding human J chain as described in Example 18. Two-fold serial dilutions of the purified 2H7 Ig fusion proteins starting at 5 µg/ml were added to the labeled BJAB cells ($5 \times 10^4$ cells per well of 96 well tissue culture plate) in the presence of whole blood (100 µl of whole blood diluted 1:1 in Alsever's solution, final dilution 1:4) and incubated for five hours at 37° C. Culture supernatants were harvested and analyzed as described in Example 11. Percent specific killing was calculated according to the following equation: ((experiment release minus spontaneous release)/(maximum release minus spontaneous release))×100. The data are presented in FIG. 37. Each data point represents the average of quadruplicate samples.

In a second ADCC assay, the number of labeled BJAB target cells was held constant in each sample, and whole blood was added at dilutions of 0.25, 0.125, and 0.0625. Purified 2H7 IgG and IgA fusion proteins were added at a concentration of 5 µg/ml. The BJAB cells, whole blood, and fusion proteins were incubated, the supernatants harvested, and the percent specific killing was calculated as described above. Percent specific killing for each of the 2H7 fusion proteins is presented in FIG. 38.

The ADCC activity of purified 2H7 scFv IgG MTH (SSS) WTCH2CH3 (5 µg/ml) and of purified 2H7 scFv IgAH IgACH2CH3 (5 µg/ml) was compared in the presence of different effector cell populations. PBMC were isolated from whole blood as described in Examples 11 and 12. PBMC were combined with labeled BJAB target cells ($5 \times 10^4$ per well of 96 well tissue culture plate) at ratios of 50:1, 25:1, and 12.5:1. The assay was performed and the data analyzed as described above. FIG. 39A shows that only the 2H7 scFv IgG MTH (SSS) WTCH2CH3 fusion protein had ADCC activity when PBMC served as the effector cells. FIG. 39B shows that both 2H7 scFv IgG MTH (SSS) WTCH2CH3 and 2H7 scFv IgAH IgACH2CH3 exhibit ADCC activity when whole blood was the source of effector cells (as illustrated in FIG. 38).

Example 20

Expression Level of 2H7 scFv VH11ser IgG MTH (SSS) WTCH2CH3 Fusion Protein

This Example compares the expression level of 2H7 scFv VH11Ser IgG MTH (SSS) WTCH2CH3 fusion protein (SEQ ID NO:370) with other 2H7 scFv IgG constructs that do not contain the mutation in the variable heavy chain domain. The mammalian expression vector pD18 comprising nucleotide sequences 2H7 scFv IgG MTH (SSS) WTCH2CH3 (SEQ ID NO:370); 2H7 scFv IgG MTH (CSS) WTCH2CH3 (SEQ ID NO:372); 2H7 scFv IgG MTH (SCS) WTCH2CH3 (SEQ ID NO:137); 2H7 scFv IgG WTH (CCC) WTCH2CH3 (SEQ ID NO:28); and 2H7 scFv VHSER11 IgG MTH (SSS) WTCH2CH3 (see Examples 1 and 13) were transiently transfected into COS cells as described in Example 10. After 72 hours at 37° C., culture supernatants were harvested, and 1 µl of each supernatant was combined with non-reducing sample buffer (see method described in Example 10). The culture supernatant samples and aliquots of purified 2H7 scFv IgG MTH (SSS) WTCH2CH3 (40 ng, 20 ng, 10 ng/5 ng, and 2.5 ng) were fractionated on 10% Bis-Tris (MOPS) NuPAGE® gels (Invitrogen Life Technologies). Multimark® protein standards (Invitrogen Life Technologies) were also separated on the gel. The proteins were transferred to a PDVF membrane and immunoblotted as described in Example 17. The immunoblot is presented in FIG. 40. The amounts of the fusion proteins were quantified by densitometry analysis of the blots using the ScionImage for Windows software and comparison with the standard curve. The 2H7 scFv IgG WTH (CCC) WTCH2CH3 construct produced approximately 12 ng/ul or 12 micrograms/ml, the 2H7 scFv IgG MTH (CSS) WTCH2CH3 produced approximately 10 ng/ul or 10 micrograms/ml, the 2H7 scFv IgG MTH (SCS) WTCH2CH3 construct produced approximately 1 ng/ul or 1 microgram/ml, and the 2H7 scFv VHSER11 IgG MTH (SSS) WTCH2CH3 construct produced approximately 30 ng/ml or 30 micrograms/ml. In particular claimed embodiments the instant invention, an amino acid sequence of 2H7 scFv VHSER11 IgG MTH (SSS) WTCH2CH3, or a polynucleotide sequence that encodes 2H7 scFv VHSER11 IgG MTH (SSS) WTCH2CH3 may be optionally excluded from the instant invention. Similarly, an amino acid sequence of 2H7 scFv VHSER11 IgG WTH (CCC) WTCH2CH3, or a polynucleotide sequence that encodes 2H7 scFv VHSER11 IgG WTH (CCC) WTCH2CH3 may be optionally excluded from particular claimed embodiments of the instant invention. Additionally, an amino acid substitution of a leucine at position 11 to serine in the variable heavy chain domain, or polynucleotides that encode an amino acid substitution of a leucine at position 11 to serine in the variable heavy chain domain, may be optionally excluded from particular claimed embodiments of the instant invention.

Example 21

Construction of a 2H7 scFv IgG Fusion Protein with a Mutant CH3 Domain

Amino acid mutations were introduced into the CH3 domain of a 2H7 IgG fusion protein. The pD18 vector comprising 2H7 scFv IgG MTH (SSS) WTCH2CH3 (SEQ ID NO:135) was digested with BclI and XbaI to remove the MTH WTCH2CH3 fragment, which was then subcloned into pShuttle vector (BD Biosciences Clontech, Palo Alto, Calif.) that was double-digested with BclI and XbaI. Subcloning was performed in a kanamycin resistant vector because the ampicillin resistance gene has an XmnI site, which is required for this cloning procedure. Five constructs were prepared with the following substitutions: (1) a phenylalanine residue at position 405 (numbering according to Kabat et al. supra) was substituted with tyrosine using the oligonucleotide CH3Y405; (2) the phenylalanine position at 405 was substituted with an alanine residue using the oligonucleotide CH3A405; (3) the tyrosine residue at position 407 was substituted with an alanine using the oligonucleotide CH3A407; (4) both wild type amino acids at positions 405 and 407 were substituted with tyrosine and alanine, respectively using the oligonucleotide CH3Y405A407; and (5) both wild type amino acids at positions 405 and 407 were substituted with alanine using the oligonucleotide CH3A405A407. The oligonucleotides were the 3' primers for PCR amplification of a portion of the CH3 domain. The nucleotide sequences for each 3' oligonucleotide were as follows.

```
CH3Y405:
                                        (SEQ ID NO: 568)
5'-gtt gtt gaa gac gtt ccc ctg ctg cca cct gct ctt
gtc cac ggt gag ctt gct gta gag gta gaa gga gcc-3'

CH3A405:
                                        (SEQ ID NO: 569)
5'-gtt gtt gaa gac gtt ccc ctg ctg cca cct gct ctt
gtc cac ggt gag ctt gct gta gag ggc gaa gga gcc-3'

CH3A407:
                                        (SEQ ID NO: 570)
5'-gtt gtt gaa gac gtt ccc ctg ctg cca cct gct ctt
gtc cac ggt gag ctt gct ggc gag gaa gaa gga gcc-3'

CH3Y405A407:
                                        (SEQ ID NO: 571)
5'-gtt gtt gaa gac gtt ccc ctg ctg cca cct gct ctt
gtc cac ggt gag ctt gct ggc gag gta gaa gga gcc-3'

CH3A405A407:
                                        (SEQ ID NO: 572)
5'-gtt gtt gaa gac gtt ccc ctg ctg cca cct gct ctt
gtc cac ggt gag ctt gct ggc gag ggc gaa gga gcc-3'
```

The template was the mutant hinge MHWTCH2CH3 human IgG1. The 5' PCR oligonucleotide primer was huIgGMHWC. The amplified products were TOPO® cloned and sequenced as described in Examples 1 and 10. DNA from the clones with the correct sequence was digested with BclI and XmnI and transferred to pShuttle containing the MTH WTCH2CH3 sequence, which was also digested with the same restriction enzymes. The mutated IgG sequences were then removed by digestion with BclI and XbaI and inserted into a pD18 vector containing 2H7 scFv that was also digested with BclI and XbaI. The polynucleotide sequences for mutated the CH3 domains, MTCH3Y405, MTCH3A405, MTCH3A407, MTCH3Y405A407, and MTCH3 A405A407 are shown in SEQ ID NOs:143, 145, 147 and 149, respectively, and the polypeptide sequences for each are shown in SEQ ID NOs:144, 146, 148 and 150, respectively. The polynucleotide sequences for the 2H7 scFv MTH WTCH2 MTCH3 Y405, 2H7 scFv MTH WTCH2 MTCH3 A405, scFv MTH WTCH2 MTCH3 A407, scFv MTH WTCH2 MTCH3 Y405A407, and scFv MTH WTCH2 MTCH3 A405A407, respectively, and the deduced amino acid sequences are shown in SEQ ID NOs:154, 156, 158, 160 and 162, and the deduced nucleotide sequences are shown in SEQ ID NOs: 153, 155, 157, 159, 161, respectively, respectively.

Example 22

Construction of 2H7 scFv IgG Fusion Proteins with Hinge Mutations

A 2H7 scFv IgG fusion protein was constructed with the third cysteine residue in the IgG1 hinge region substituted with a serine residue. The template for introduction of the mutations was a polynucleotide encoding 2H7 scFv WTH WTCH2CH3 (SEQ ID NO:28). The oligonucleotide introducing the mutations was a 5' PCR primer oligonucleotide HIgGMHcys3 having the sequence 5'-gtt gtt gat cag gag ccc aaa tct tgt gac aaa act cac aca tgt cca ccg tcc cca gca cct-3' (SEQ ID NO:573). The oligonucleotide introducing the mutation into the hinge region was combined with template and a 3' oligonucleotide containing an XbaI site (underlined and italicized) (5'-gtt gtt _tctaga_ tca ttt acc cgg aga cag gga gag gct ctt ctg cgt gta g-3' (SEQ ID NO:574)) to amplify the mutant hinge-wild type (WT)-CH2-CH3 sequences by PCR. The IgG MTH CCS mutant sequence was amplified for 30 cycles with a denaturation profile of 94° C., annealing at 50° C. for 30 seconds, and extension at 72° C. for 30 seconds. The amplified polynucleotides were inserted into the TOPO® cloning vector (Invitrogen Life Technologies) and then were sequenced as described in Example 1 to confirm the presence of the mutation. pD18 vector containing 2H7 scFv was digested to remove the constant region sequences essentially as described in Example 10. The mutant hinge-wild type CH2-CH3 regions were inserted in frame into the digested vector DNA to obtain vectors comprising 2H7 scFv MTH (CCS) WTCH2CH3 encoding DNA (SEQ ID NO:167). The deduced polypeptide sequence is shown in SEQ ID NO:168.

Example 23

Construction of Anti-CD20 IgE Fusion Proteins

A binding domain is fused to IgE constant region sequences such that the expressed polypeptide is capable of inducing an allergic response mechanism. The single chain Fv nucleotide sequence of 40.2.220 (SEQ ID NO:35), an anti-CD40 antibody, is fused to IgE CH2-CH3-CH4 according to methods described for other scFv immunoglobulin constant region constructs (see Examples 1, 5, 10, and 13). To PCR amplify the IgE CH2-CH3-CH4 domains, a 5' oligonucleotide primer, hIgE5Bcl, having the sequence 5'-gtt gtt gat cac gtc tgc tcc agg gac ttc acc cc-3' (SEQ ID NO:575), and a 3' oligonucleotide primer, hIgE3stop, having the sequence 5'-gtt gtt tct aga tta act ttt acc ggg att tac aga cac cgc tcg ctg g-3' (SEQ ID NO:576) are used.

The retroviral transfection system for ectopic surface expression of genetically engineered cell surface receptors composed of scFvs that bind costimulatory receptors described in Example 12 is used to construct a 40.2.220 scFv IgE-CD80 fusion protein. The 40.2.220 scFv IgE fusion polynucleotide sequence is fused in frame to sequences encoding the transmembrane domain and cytoplasmic tail of human CD80 (SEQ ID NO:30), such that when the fusion protein is expressed in the transfected cell, CD80 provided an anchor for surface expression of the scFv Ig fusion protein. cDNA encoding the anti-CD40 scFv-IgE-CD80 fusion proteins is inserted into the retroviral vector pLNCX (BD Biosciences Clontech) according to standard molecular biology procedures and vendor instructions. The 40.2.220 scFv-Ig-CD80 cDNA is inserted between the 5'LTR-neomycin resistance gene-CMV promoter sequences and the 3'LTR sequence. The retroviral constructs are transfected into a carcinoma cell line, and transfected cells are screened to select clones that are expressing the 40.2.220 scFv-Ig-CD80 fusion protein on the cell surface.

Example 24

Construction of IgA-T4 Mutants that are Expressed on the Cell Surface

The retroviral transfection system for ectopic surface expression of genetically engineered cell surface receptors composed of scFvs that bind costimulatory receptors described in Example 12 is used to construct a 2H7 scFv IgA hinge IgA-T4-CD80 fusion protein. The 2H7 scFv IgAH IgA-T4 fusion polynucleotide sequence (SEQ ID NO:70) is fused in frame to sequences encoding the transmembrane domain and cytoplasmic tail of human CD80 (SEQ ID NO:29), such that when the fusion protein is expressed in the transfected cell, CD80 provided an anchor for surface expression of the scFv Ig fusion protein. cDNA encoding the 2H7 scFv IgAH IgA-T4-CD80 fusion protein is inserted into the retroviral vector pLNCX (BD Biosciences Clontech) according to standard molecular biology procedures and vendor instructions. The 2H7 scFv IgAH IgA-T4-CD80 cDNA is inserted between the 5'LTR-neomycin resistance gene-CMV promoter sequences and the 3'LTR sequence. The retroviral construct is transfected into Reh, an acute lymphocytic leukemia cell line (ATCC CRL-8286). Transfected cells are screened to select clones that are expressing 2H7 scFv-Ig fusion proteins on the cell surface.

Example 25

Characterization of an Anti-4-1BB scFv Ig-CD80 Fusion Protein Expressed on the Cell Surface of Tumor Cells and Growth of the Tumor Cells In Vivo This Example describes construction of an anti-murine 4-1BB (CD137) scFv fusion protein that has an IgG wild type hinge and CH2 and CH3 domains that is fused to the CD80 transmembrane and cytoplasmic domains. The Example also illustrates the effect of the cell surface expression of the anti-4-1BB scFv IgG CD80 polypeptide when the transfected tumor cells are transplanted into mice.

The heavy and light chain variable regions of a rat anti-4-1BB (CD137) monoclonal antibody (1D8) were cloned, and a single chain Fv construct was prepared essentially as described in Example 1. The heavy chain and light chain variable regions of each antibody were cloned according to standard methods for cloning immunoglobulin genes and as described in Example 1. Aingle chain Fv construct was prepared as described in Example 1 by inserting a nucleotide sequence encoding a $(gly_4ser)_3$ (SEQ ID NO:529) peptide linker between the VL region nucleotide sequence of 1D8 (SEQ ID NO:102) and the VH region nucleotide sequence of 1D8 (SEQ ID NO:100). The polypeptide sequence for 1D8 VL is shown in SEQ ID NO:103, and the polypeptide sequence for the VH domain is shown in SEQ ID NO:101. The scFv polynucleotide (SEQ ID NO:104) was then fused to human IgG1 wild-type hinge-CH2-CH3 domains according to the methods described in Example 1. The scFv IgG1 fusion polynucleotide sequence was then fused in frame to sequences encoding the transmembrane domain and cytoplasmic tail of human CD80 (SEQ ID NO:29) essentially as described in Example 12, such that when the fusion protein was expressed in the transfected cell, CD80 provided an anchor for surface expression of the scFv Ig fusion protein. cDNA encoding the scFv-IgG-CD80 fusion protein (SEQ ID NO:110) was inserted into the retroviral vector pLNCX (BD Biosciences Clontech) according to standard molecular biology procedures and vendor instructions. The scFv-Ig-CD80 cDNA was inserted between the 5'LTR-neomycin resistance gene-CMV promoter sequences and the 3'LTR sequence.

The retroviral constructs were transfected into the metastatic M2 clone of K1735, a melanoma cell line, provided by Dr. I. Hellstrom, PNRI, Seattle, Wash. Transfected cells were screened to select clones that were expressing scFv-Ig fusion proteins on the cell surface. To demonstrate that the 1D8 scFv IgG-CD80 construct was expressed on the cell surface of the tumor cells, the transfected cells were analyzed by flow immunocytofluorimetry. Transfected cells (K1735-1D8) were incubated for one hour on ice in phycoerythrin-conjugated F(ab')$_2$ goat anti-human IgG. The unbound conjugate was then removed by washing the cells and flow cytometry analysis was performed using a Coulter Epics XL cell sorter. Results are presented in FIG. 41A.

The growth of K1735-1D8 transfected cells was examined in vivo. K1735-WT cells grew progressively when transplanted subcutaneously (s.c.) in naïve C3H mice. Although the same dose of K1735-1D8 cells initially formed tumors of an approximately 30 mm$^2$ surface area, the tumors started to regress around day 7 and had disappeared by day 20 as shown in FIG. 41B. Tumor cells that were transfected with a similarly constructed vector encoding a non-binding scFv, a human anti-CD28 scFv construct, grew as well as tumor cells that had not been transfected. The presence of a foreign protein, that is, human IgG1 constant domains or rat variable regions, did not make transfected K1735-WT cells immunogenic; the growth of the K1735-1D8 cells in C3H mice was identical to that of K1735-WT cells (untransfected).

To investigate the roles of CD4$^+$ and CD8$^+$ T lymphocytes and NK cells in the regression of K1735-1D8 tumors, naïve mice were injected intraperitoneally (i.p.) with monoclonal antibodies (monoclonal antibodies, typically 50 µg in a volume 0.1 ml) to remove CD8$^+$, CD4$^+$ or both CD4$^+$ and CD8$^+$ T cells, or were injected with anti-asialo-GM1 rabbit antibodies to remove NK cells. Twelve days later, when flow cytometry analysis of spleen cells from identically treated mice showed that the targeted T cell populations were depleted, K1735-1D8 cells were transplanted s.c to each T cell-depleted group. K1735-1D8 had similar growth kinetics in mice that had been injected with the anti-CD8 MAb or control rat IgG while removal of CD4' T cells resulted in the growth of K1735-1D8 with the same kinetics as K1735-WT. This failure to inhibit tumor growth after CD4+ T cell removal was observed regardless of the presence or absence of CD8+ T cells. K1735-1D8 grew in all NK-depleted mice, although more slowly than in the CD4-depleted group. The results are presented in FIG. 41C.

Example 26

Therapeutic Effect of Tumor Cells Expressing Anti-4-1BB scFv IgG-CD80 Fusion Protein This Example examines the ability of K1735-1D8 transfected tumor cells expressing an anti-CD137 scFv on the cell surface to generate a sufficient immune response in mice to mediate rejection of established, untransfected wild type tumors. C3H mice were transplanted with K1735-WT tumors (2×10$^6$ cells/animal) and grown for approximately six days. Experiments were performed using mice with established K1735-WT tumors of 30 mm$^2$ surface area. Mice were vaccinated by s.c. injection of K1735-1D8 or irradiated K1735-WT cells on the contralateral side. Identical injections were repeated at the time points indicated in FIG. 42. One group of animals was given four weekly injections of K1735-1D8 cells. According to the same schedule, another group was given irradiated (12,000 rads) K1735-WT cells, and a third group was injected with PBS. The data are plotted in FIG. 42. The WT tumors grew progressively in all control mice and in all mice that received irradiated K1735-WT cells. In contrast, the tumors regressed in 4 of the 5 mice treated by immunization with K1735-1D8. The animals remained tumor-free and without signs of toxicity when the experiment was terminated 3 months later. In the fifth mouse, the tumor nodule decreased in size as long as the mouse received K1735-1D8 cells, but the tumor grew back after therapy was terminated.

In another experiment with 5 mice/group, mice were injected intravenously (i.v.) with $3\times10^5$ K1735-WT cells to initiate lung metastases. Three days later, K1735-1D8 cells were transplanted s.c. This procedure was repeated once weekly for a month; control mice were injected with PBS. The experiment was terminated when one mouse in the control group died, 37 days after receiving the K1735-WT cells. At that time, lungs of the control mice each had >500 metastatic foci. In contrast, less than 10 metastatic foci were present in the lungs of the immunized mice.

In a third experiment, mixtures of K1735-WT cells and K1735-1D8 cells were injected into immunocompetent syngeneic C3H mice. Mice were injected subcutaneously with K7135-WT cells alone or with a mixture of $2\times10^6$ K1735-WT cells and $2\times10^5$ K1735-1D8 cells. Tumor growth was monitored at 5-day intervals.

Example 27

Expression of Anti-4-1BB scFv IgG-CD80 Fusion Protein on the Cell Surface of Sarcoma Cells This Example demonstrates expression of an anti-CD137 scFv on the cell surface of a second type of tumor cell by transfecting a murine sarcoma cell line with an anti-CD137 scFv IgG-CD80 construct.

The 1D8 scFv IgG WTH WTCH2CH3-CD80 polynucleotide (SEQ ID NO:110) was transferred from the pLNCX vector into pcDNA3-hygro vector using restriction enzyme digestion and ligation steps according to standard molecular biology methods. The consruct was cut with HindIII+Cla1 and thesFv fragment was filled in with Klenow (Roche) and the blunt-ended fragment was ligated into EcoR5 site of pcDNA3. Ag104 murine sarcoma tumor cells were transfected with the pcDNA3-hygro vector containing the 1D8 scFv IgG CD80 fusion protein. Hygromycin-resistant clones were screened by flow cytometry using a FITC anti-human IgG antibody to detect expression of the transgene. Only approximately 15% of the resistant clones had detectable fusion protein initially. Positive cells identified by flow cytometry were repeatedly panned on flasks coated with immobilized anti-human IgG (10 μg/ml) according to standard methods. Panning was performed by incubating cells on the coated plates for 30 min at 37 C; the plates were then washed 2-3× in versene or PBS. After each round, cells were tested for IgG expression by FACS. The histogram in FIG. 44 shows the staining pattern after four rounds of panning against anti-human IgG (black). Untransfected cells were stained and are indicated in gray. All of the cells in the population were positive.

Example 28

Construction and Characterization of a Bispecific scFv Ig Fusion Protein and scFv Ig Fusion Proteins with a Mutation in the IgG1 CH2 Domain An anti-CD20 (2H7) scFv IgG fusion protein was constructed that had a mutant hinge (MT (SSS)) and a mutant CH2 domain in which the proline at residue (position number 238 according to Ward et al., supra) was substituted with a serine. The 2H7 scFv IgG MTH (SSS) MTCH2WTCH3 encoding polynucleotide (SEQ ID NO:130) was constructed essentially according to methods described in Examples 1, 5, and 13. The IgG mutant hinge-mutant CH2-wild type CH3 domains were also fused to an anti-CD20 (2H7)-anti-CD40 (40.2.220) bispecific scFv. The anti-CD20-anti-CD40 scFv IgG MTH (SSS) MTCH2WTCH3 encoding polynucleotide sequence is shown in SEQ ID NO:114 and the encoded polypeptide is shown in SEQ ID NO:115.

COS cells were transiently transfected with vectors comprising the polynucleotide sequences encoding 2H7 scFv IgG MTH (SSS) MTCH2WTCH3 (SEQ ID NO:131); anti-CD20-anti-CD40 scFv IgG MTH (SSS) MTCH2WTCH3 (SEQ ID NO:114); 2H7 scFv IgG MTH (SSS) WTCH2CH3 (SEQ ID NO:58); and 2H7 scFv IgAH IgG WTCH2CH3 (SEQ ID NO:60) as described in Example 10. Culture supernatants were collected and the fusion proteins were purified by protein A chromatography (see Example 10). The purified polypeptides were fractionated by SDS-PAGE according to the method described in Example 10. Rituximab (anti-CD20 monoclonal antibody), and Bio-Rad prestained molecular weight standards (Bio-Rad, Hercules, Calif.), and Multimark® molecular weight standards (Invitrogen Life Technologies were also applied to the gel. The results are presented in FIG. 45.

The 2H7 scFv Ig fusion protein that contains a mutation in the CH2 domain was compared to fusion proteins that have the wild type CH2 domain in an ADCC assay. The assays were performed essentially as described in Examples 11 and 19. Fresh resting PBMC (effector cells) were added to $^{51}$Cr-labeled BJAB cells (target cells) at the ratios indicated in FIG. 46. Purified 2H7 scFv IgG MTH (SSS) MTCH2WTCH3, 2H7 scFv IgG MTH (SSS) WTCH2CH3, 2H7 scFv IgAH IgG WTCH2CH3, and Rituximab, each at 10 μg/ml were added to the effector/target cell mixtures and incubated for five hours at 37° C. Supernatants were harvested and the amount of chromium released was determined as described in Examples 11 and 19. Percent specific killing by each fusion protein is presented in FIG. 46.

Example 29

Tumor Cell Surface Expression of an Anti-Human CD3 scFv IgG Fusion Protein

An anti-human CD3 scFv Ig CD80 fusion protein was prepared essentially as described in Examples 1 and 12. The fusion protein comprised an anti-human CD3 scFv fused to wild type IgG1 hinge (SEQ ID NO:12) and wild type CH2 (SEQ ID NO:13) and CH3 (SEQ ID NO:15) domains, fused to CD80 transmembrane and cytoplasmic domains (SEQ ID NO:29) to enable cell surface expression of the anti-CD3 scFv. The anti-human CD3 scFv IgG WTH WTCH2CH3-CD80 polynucleotide (SEQ ID NO:110) encoding the polypeptide (SEQ ID NO:111) was transfected in Reh cells and into T51 cells (lymphoblastoid cell line). Expression of the anti-human CD3 scFv IgG fusion protein was detected by flow cytometry using FITC conjugated goat anti-human IgG (see methods in Examples 4, 10, 16, 18). FIG. 47A illustrates expression of the anti-human CD3 fusion protein on the cell surface of Reh cells, and FIG. 47B shows expression of the fusion protein on T41 cells.

ADCC assays were performed with the transfected Reh and T51 cells to determine if expression of the scFv-Ig polypeptides on the cell surface augmented effector cell function. Untransfected Reh cells and untransfected and transfected T51 cells were pre-labeled with $^{51}$Cr (100 μCi) (Amersham) for two hours at 37° C. Human PBMC served as effector cells and were added to the target cells ($5\times10^4$ cells per well of 96 well plate) at ratios of 20:1, 10:1, 5:1, and 2.5:1. After four hours at 37° C., culture supernatants were harvested and analyzed as described in Examples 11 and 12. Percent specific killing was calculated as described in Example 12. The results are presented in FIG. 48.

Example 30

Induction of Cytokine Expression in Tumor Cells Expressing Anti-CD28 scFv on the Cell Surface This Example describes the effect of cell surface expressed scFv on cytokine mRNA induction in stimulated lymphocytes co-cultured with tumor cells transfected with an anti-human CD28 scFv IgG-CD80 fusion protein.

Real time PCR analysis was performed on RNA samples from human PBMC stimulated with Reh, Reh-anti-CD28 (2e12) (see Example 12 for construction of 2e12 scFv IgG WTH WHTCH3CH2-CD80 and transfection of Reh cells), and Reh-CD80 (see Example 14) in order to measure the effects of the surface expressed scFv on cytokine production by the PBMC effector cells. For the real-time PCR assay, SYBR Green (QIAGEN) (Morrison et al., *Biotechniques* 24:954-8, 960, 962 (1998)) was used and measured by an ABI PRISM® 7000 Sequence Detection System (Applied Biosystems, Foster City, Calif.) that measures the formation of PCR product after each amplification cycle. Cells were harvested from cultures and total RNA prepared using QIAGEN RNA kits, including a QIA shredder column purification system to homogenize cell lysates, and RNeasy® mini-columns for purification of RNA. cDNA was reverse transcribed using equal amounts of RNA from each cell type and Superscript II Reverse Transcriptase (Life Technologies). SYBR Green real-time PCR analysis was then performed using the prepared cDNA as template and primer pairs specific for cytokine gene products. The average length of the PCR products that were amplified ranged from 150-250 base pairs. The cDNA levels for many activation response molecules including IFNγ, TNFα, GM-CSF, IL-4, IL-5, IL-6, IL-8, IL-10, IL-12, IL-15, ICOSL, CD80 and CD86 were assayed. Control reference cDNAs for constitutively expressed genes, including GAPDH, β-actin, and CD3ε were measured in each assay. The most significant induction of specific mRNA was observed for IFN-γ, and more modest induction was observed for CTLA-4 and ICOS.

Example 31

Cloning of an Anti-Human 4-1BB Antibody and Construction of an Anti-Human 4-1BB scFv Ig Fusion Protein A hybridoma cell line expressing a mouse anti-human monoclonal antibody (designated 5B9) was obtained from Dr. Robert Mittler, Emory University Vaccine Center, Atlanta, Ga. The variable heavy and light chain regions were cloned according to known methods for cloning of immunoglobulin genes and as described herein. Cells were grown in IMDM/15% FBS (Invitrogen Life Technologies) media for several days. Cells in logarithmic growth were harvested from cultures and total RNA prepared using QIAGEN RNA kits, including a QIA shredder column purification system to homogenize cell lysates, and RNeasy® mini-columns for purification of RNA according to manufacturer's instructions. cDNA was reverse transcribed using random hexamer primers and Superscript II Reverse Transcriptase (Invitrogen Life Technologies).

cDNA was anchor-tailed using terminal transferase and dGTP. PCR was then performed using an anchor-tail complementary primer and a primer that annealed specifically to the antisense strand of the constant region of either mouse Ck (for amplifcation of VL) or the appropriate isotype mouse CH1 (for amplification of VH). The amplified variable region fragments were TOPO® cloned (Invitrogen Life Technologies), and clones with inserts of the correct size were then sequenced. Consensus sequence for each variable domain was determined from sequence of at least four independent clones. The 5B9 VL and VH polynucleotide sequences are shown in SEQ ID NOs:120 and 116, respectively, and the deduced amino acid sequences are shown in SEQ ID NOs: 121 and 118. The scFv was constructed by a sewing PCR method using overlapping primers containing a synthetic $(Gly_4Ser)_3$ (SEQ ID NO:529) linker domain inserted between the light and heavy chain variable regions (see Example 1). The 5B9 scFv polypeptide (SEQ ID NO:123) is encoded by the polynucleotide sequence comprising SEQ ID NO:122.

5B9 scFv polynucleotide sequence was fused in frame to the polynucleotide sequence encoding the human IgG1 mutant hinge and wild type CH2 and CH3 (MTH (SSS) WTCH2CH3, according to methods described in Examples 5, 10, and 13. COS cells were transiently transfected with a vector comprising the 5B9 scFv IgG MTH (SSS) WTCH2CH3 polynucleotide sequence (SEQ ID NO:132). Supernatant was collected and binding of the 5B9 scFv IgG MTH (SSS) WTCH2CH3 polypeptide (SEQ ID NO:133) was measured by flow immunocytofluorimetry essentially as described in Examples 4, 10, 16, and 18. Culture supernatant from the 5B9 hybridoma cell line was also included in the binding assay. Fresh human PBMC were incubated in the presence of immobilized anti-CD3 for four days prior to the binding experiment to induce expression of CD137 on the surface of activated T cells. Stimulated PBMC were washed and incubated with COS or hybridoma culture supernatant containing the 5B9 scFv IgG fusion protein or 5B9 murine monoclonal antibody, respectively, for 1 hour on ice. Binding of 5B9 scFv IgG fusion protein or 5B9 murine monoclonal antibody was detected with FITC conjugated anti-human IgG or anti-mouse IgG, respectively. The results are presented in FIG. 49.

Example 32

Construction of 2H7 scFv IgG Fusion Proteins with Hinge Mutations

2H7 scFv IgG fusion proteins are constructed with the first cysteine residue and the second cystein in the IgG1 hinge region substituted with a serine residue to provide MTH (SCC) and MTH (CSC). The template for introduction of the mutations is a polynucleotide encoding 2H7 scFv WTH WTCH2CH3. The oligonucleotide introducing the mutations are 5' PCR primer oligonucleotides HIgGMHcys1 (SEQ ID NO:140) and HIgGMHcys2 (SEQ ID NO:141). The constructs are prepared as described previously. The encoding polynucleotides of the mutants are presented in SEQ ID NOs: 163 and 165) and the polypeptide sequences are provided in SEQ ID NO:164 and 166).

Example 33

Construction of 2H7 $V_H$L11S scFv (SSS-S) H WCH2 WCH3

A change from leucine to serine at position 11 in the heavy chain variable region (numbering according to Kabat et al., *Sequences of Proteins of Immunological Interest*, 5th ed.

Bethesda, Md.: Public Health Service, National Institutes of Health (1991)) was introduced into the 2H7 scFv MTH (SSS) WTCH2CH3 fusion protein (SEQ ID NO:58). The wild type leucine residue was substituted with serine by site-directed mutagenesis using the oligonucleotide Vhser11: 5'-gga ggt ggg agc tct cag gct tat cta cag cag tct ggg gct gag tcg gtg agg cc-3' (SEQ ID NO:577). The 3'-primer for PCR was huIgG1-3' having the sequence 5'-gtc tctaga cta tca ttt acc cgg aga cag-3' (SEQ ID NO:578) (XbaI site underlined and italicized). After PCR amplification, the fragments were inserted into the TOPO® cloning vector and sequenced to confirm the presence of the VH11 leucine to serine mutation. The 2H7 scFv-IgG (SSS-S) H WCH2 WCH3 encoding DNA was shuttled into the PSL1180 cloning vector (Pharmacia Biotech, Inc., Piscataway, N.J.). The construct PSL1180-2H7 scFv-IgG (SSS-S) H WCH2 WCH3 was digested with Sac and XbaI to remove the wild type VH domain and the connecting region and CH2 and CH3 domains. The PCR product comprising the VH11 mutant was digested with Sac and XbaI and then inserted into the digested PSL1180 construct according to standard molecular biology procedures. The construct was then digested with Hind III and XbaI, and inserted into the mammalian expression vector pD18 (see methods described in Example 1 and Example 10). The mutant is designated 2H7 scFv VH L11S IgG (SSS-S) H WCH2 WCH3. The polynucleotide sequence is provided in SEQ ID NO:369, and the encoded polypeptide sequence is provided in SEQ ID NO:370.

Example 34

Expression and of 2H7 scFv VH L11S (SSS-S) H WCH2 WCH3 in Stable CHO Lines

CHO DG44 cells were transfected by electroporation with approximately 150 micrograms of linearized expression plasmid encoding the 2H7 VH L 11S scFv (SSS-S) H WCH2 WCH3. Cultures were plated in selection media containing 100 nM methotrexate, in 96 well, flat bottom tissue culture plates at various numbers of cells/well, ranging from 125 to 2000. Methotrexate resistant clones were selected and culture supernatants were screened for the highest expressors of the fusion protein using a CD20CHO binding assay similar to that described for FIG. 1. Clones were amplified after the initial selection in gradually increasing doses of methotrexate. Cells were passaged for two passages in the higher concentration prior to adjusting the concentration to the next higher dose. Clones were amplified to a final concentration of 1 micromolar methotrexate.

FIG. 50B illustrates the production levels of 2H7 VH L11S scFv (SSS-S) H WCH2 WCH3. Spent supernatants from amplified CHO cells expressing this molecule and growing in stationary T25 flasks were tested for quantitative binding to CD20 CHO cells by flow cytometry. The activity was converted to protein concentration by generation of a standard curve using the same molecule purified from supernatants with Protein A affinity chromatography (FIG. 50A). The concentration of the purified protein was determined by A280 using an extinction coefficient provided by the amino acid composition of the recombinant protein (Vector NTI). Although levels of production varied between clones tested, multiple clones produced over 1 mg/ml. This level of protein expression is over 10-fold higher than the identical molecule except for the amino acid change in $V_H$.

FIG. 51 illustrates the production levels of 2H7 VH L11S scFv (SSS-S) H WCH2 WCH3 by semi-quantitative analysis on SDS-PAGE. Ten microliters of spent supernatant from amplified CHO cells expressing this molecule and growing in stationary T25 flasks were mixed with 10 microliters 2x non-reducing SDS sample buffer, run on SDS-PAGE gels, and stained with coomassie blue.

Example 35

Construction and Binding Capacity of G28-1 scFv Ig Constructs

Contrstruction of the G28-1 (anti-CD37) scFv was performed using total RNA isolated from the G28-1 hybridoma using Trizol (Invitrogen) reagent according to manufacturer's instructions. cDNA was prepared using random primers and the protocol described previously for 2H7 cloning in Example 1. The variable domains of the scFv was cloned using one of two methods: the first method used a family of degenerate 5' oligonucleotides specific for each V region gene family and a single 3' primer specific for the constant region of either the light or heavy chain using methods and primers described in (Ig-Prime Kit Mouse Ig-Primer Set, Novagen). The second approach used the anchor-tailing methods and primers described in (Gilliland L K et al, Tissue Antigens 47: 1-20 (1995). In either case, PCR amplified products were cloned into the TOPO cloning vector (Invitrogen). The clones were digested with EcoRI and screened for inserts of the proper size. Positive clones were sequenced as previously described in Example 1.

Specific primers were then designed for each V region, one with the leader sequence and one without. Primers were also designed to include desired linkers and/or restriction sites at the primer ends. PCR reactions were performed on the TOPO cloned DNA using a 25 cycle program with the following profile: 94 C, 30 sec; 55 C, 30 sec; 72 C, 30 sec, followed by a final extension at 72 C for 8 minutes. PCR products were gel purified and fragments recovered using a QIAQUICK gel extraction kit (QIAGEN, Valencia, Calif.). Fragments were diluted 1:50 and 1 microliter used for SEWING PCR reactions according to the methods described in Example 1. The following oligonucleotides were used for the secondary PCR reactions of the $V_L$ domain for the G28-1 scFv:

```
5' primers with SalI site without leader:
                                  (SEQ ID NO: 579)
5'-GTTGTTGTCGACATCCAGATGACTCAGTC
TCCA-3'

5' primer with HindIII site and leader sequence:
                                  (SEQ ID NO: 580)
5'-GTCAAGCTTGCCGCCATGGTATCCA
CAGCTCAGTTCCTTGG-3'

3' primer:
                                  (SEQ ID NO: 581)
5'-GCCACCCGACCCACCACCGCCCGAGCCACCGCCACCTTTGATCTCCA
GTTCGGTG CC-3'
```

The primers used for the $V_H$ domain are shown below:

```
5' sense primer:
                                  (SEQ ID NO: 582)
TCGGGCGGTGGTGGGTCGGGTGGCGGCGGATCGTCAGCGGTCCAGCTGCA
GCAGTCTGGA-3'

3' antisense primer with BclI site:
                                  (SEQ ID NO: 583)
5'-TCAGTGCTGATCAGAAGAGACGGTGACTGAGGTTCCTTG-3'.
```

A change from leucine to serine at position 11 in the heavy chain variable region (Kabat numbering) was introduced in into the G28-1 scFv by site-directed mutagenesis. The wild type form of the G28-1 scFv was initially constructed by sewing/overlap PCR to insert a (gly4ser)3 (SEQ ID NO:529) linker between the VL and VH domains as described above. However, no Sac I site was introduced as a part of this fusion of the variable domains, so alternative, nearby restriction sites (HaeII and PvuII) near leucine 11 were used to synthesize the VL+mutated VH domain. Primers were designed to contain one of these sites and the DNA sequence including the L to S change, followed by 12 wild type base pairs. Several attempts at this strategy failed, so an alternative strategy using the Genetailor (Invitrogen) method of site directed mutagenesis was used to introduce the desired mutation. The mutagenesis was carried out according to manufacturer's instructions. Briefly the procedure involves methylation of the plasmid DNA with DNA methylase, amplification of the DNA in a mutagenesis reaction with two overlapping primers, one of which contains the target muations, trasformation of the plasmid into wild type *E. coli* which digests all methylated DNA and leaves only the unmethylated, mutated amplification product. Both primers are approximately 30 nucleotides in length (not including the mutation site on the mutagenic primer, with an overlapping region at the 5' ends of 15-20 nucleotides, for efficient end joining of the mutagenesis product. The template for the mutagenesis reaction was 100 ng of a plasmid containing the wild type G28-1 scFvIg construct, and the primers used for the G28-1 VH mutagenesis are as follows:

```
Forward primer:
                                (SEQ ID NO: 584)
5'-GCAGCAGTCTGGACGTGAGTCGGAAAAGCCTG-3'

Reverse Primer:
                                (SEQ ID NO: 585)
5'-CTCAGGTCCAGACTGCTGCAGCTGGACCGC-3'
```

PCR reactions were performed using the 15 ng methylated template, the primers above, and the usual reaction components as previously described. A 20 cycle program with the following profile was used for amplification: 94 C, 30 sec; 55 C, 30 sec; 68 C, 8 min, followed by a final 68 C extension step for 10 minutes. PCR products were transformed into wild type bacteria, and colonies screened by sequencing. Clones with only the desired mutation were isolated and plasmid prepared as previously described Example 33. The mutant is designated G28-1 scFv VH L11S (SSS-S)H WCH2 WCH3. The polynucleotide sequence is provided in SEQ ID NO:323, and the encoded polypeptide sequence is provided in SEQ ID NO:324.

The expression level of G28-1 fusion proteins was confirmed using Immunblot analysis according to the methods described in Example 17. FIG. 53 illustrates a large increase in protein expression in the VH L11S mutant G28-1 fusion proteins compared to the G28-1 fusion protein without the mutation.

The G28-1 scFv Ig fusion proteins were transiently transfected and expressed in COS cells according to methods described in Example 10. FIG. 52 illustrates the capacity of the G28-1 scFv Ig fusion proteins from the COS supernatants to bind CD37. Ramos and BJAB cells both express human CD37, and were therefore used to screen the G28-1 supernatants for functional activity. Binding of G28-1 scFv (SSS-S) H WCH2 WCH3 and G28-1 scFv VH L11S (SSS-S) H WCH2 WCH3 to CD37+ Ramos cells was measured by flow cytometry according to methods described in Example 2. Each point on the graph represents the mean of five replicate transfections. The graph illustrates that the G28-1 scFv VH L11S (SSS-S) H WCH2 WCH3 is able to bind CD37+ Ramos cells.

Addition constructs were made with different connecting regions. The pD18 G28-1 scFv VHL11S (SSS-S) H WCH2 WCH3 vector was digested with BclI and XbaI to remove the connecting region, CH2 and CH3. Theses were replaced with each different connecting region, CH2 and CH3 according to the methods described in Example 13. The new constructs were designated: G28-1 scFv VHL11S (CSS-S) H WH2 WH3 (SEQ ID NO:325), G28-1 scFv VHL11S (CSC-S) H WH2 WH3 (SEQ ID NO:327), G28-1 scFv VHL11S (SSC-P) H WH2 WH3 (SEQ ID NO:329), G28-1 scFv VHL11S (SCS-S) H WH2 WH3 (SEQ ID NO:373), G28-1 scFv VHL11S (CCS-P) H WH2 WH3 (SEQ ID NO:375), and G28-1 scFv VHL11S (SCC-P) H WH2 WH3 (SEQ ID NO:377).

The G28-1 scFv was also attached to an IgA connecting region, CH2, CH3 and an IgE CH2, CH3, CH4. The pD18 G28-1 scFv VHL11S (SSS-S) H WCH2 WCH3 plasmid was digested using methods above to remove the connecting region CH2, and CH3. The IgA regions were inserted using methods described in Example 13. The construct was designated G28-1 scFv VHL11S IgAH IgACH2 T4CH3 (SEQ ID NO:381). The IgE CH2 CH3 CH4 region was inserted into the digested pD18 vector above using methods described in Example 39. The construct was designated G28-1 scFv VHL11S IgECH2 CH3 CH4 (SEQ ID NOs:379 and 383).

Example 36

Characterization of 2H7 scFv Ig Mutant Fusion Proteins

FIG. 54 illustrates the binding capacity of purified 2H7 scFv Ig constructs to CD20+CHO cells. The proteins were transfected into stable CHO cells according to methods described in Example 2. Binding was determined using flow cytometry according to the methods described in Example 2. The graph in FIG. 54 illustrates that these proteins retain binding function to CD20 with altered connecting regions. Comparative results were obtained in each of the 2H7 scFv VHL11S mutants with each type of altered connecting region (results omitted).

The ability of 2H7scFv-Ig constructs with mutated connecting regions to kill CD20 positive cells in the presence of peripheral blood mononuclear cells (PBMC) through ADCC was tested by measuring the release of $^{51}$Cr from labeled BJAB cells in a 4 hr. assay using 100:1 ratio of PBMC to BJAB cells. The results shown in FIG. 55 indicate that 2H7scFv-Ig mutants can mediate antibody dependent cellular cytotoxicity (ADCC), since the release of $^{51}$Cr was significantly higher in the presence of both PBMC and 2H7scFv-Ig than in the presence of either PBMC or 2H7scFv-Ig alone. Comparative results were obtained in each of the 2H7 scFv VHL11S mutants with each type of altered connecting region (results omitted).

The ability of 2H7scFv-Ig mutant fusion proteins to kill CD20 positive cells in the presence of complement was tested using B cell lines Ramos target cells. Rabbit complement was purchased from Pel-Freez (Rogers, Ak.), and was used in the assay at a final concentration of 1/10. Purified 2H7scFv-Ig was incubated with B cells and complement for 45 minutes at 37° C., followed by counting of live and dead cells by trypan blue exclusion. The results in FIG. 56 show that 2H7scFv-Ig mutants in the presence of rabbit complement lysed B cells expressing CD20.

Example 37

Comparative Binding of IgA, IgG, and IgE 2H7 scFv Constructs

Binding capacity of Ig constructs IgA, IgG and IgE were measured using flow cytrometry according to the methods described in Example 2, using a commercially available (Caltag) second step specific for each Ig tail. The results in FIG. 57 show that all the IgE constructs were able to bind CD20+ CHO cells comparable to the binding abilities of IgG and IgA. These results also demonstrate that the IgE constructs were detected with the IgE second step, but not the IgA or IgG second step.

Example 38

Construction and Characterization of 2H7 VH L11S IgE Constructs

IgE tail RNA was isolated from SKO-007 cells(ATCC) using QIAGEN QIAshredder homogenization and RNA minikits Random-primed cDNA was generated according to the usual protocol, with 4 microliters RNA eluted from the QIAGEN columns. Human IgE from the beginning of CH1 through CH4 (approximately 1.2 kb) was isolated by PCR amplification of 5 microliters cDNA, with an amplification profile of 94 C, 60 sec; 72 C, 2 minutes for 35 cycles, and the following primers:

```
5' primer:
                                        (SEQ ID NO: 586)
5'-ggatccaccgctgctgcaaaaacattccctccaatgc
cacctccgtgac-3'

3' primer:
                                        (SEQ ID NO: 587)
5'-tcatttaccgggatttacagacaccgctcgctggacg
gtctgtgagggctcgctgc-3'
```

PCR fragments were ligated into PCR 2.1-TOPO vector, and transformants screened for inserts of the correct size by digestion with EcoRI according to the methods described in Example 1. One of the clones with the correct sequence from was used as template to amplify the CH2-CH4 domains with appropriate restriction sites attached for subcloning as soluble or cell surface (ORF) forms. The following primers were used with an amplification profile of 94 C, 60 sec; 55 C, 60 sec; 72 C, 2 min; for 35 cycles to amplify a fragment of approximately 950 bp:

```
5' primer: (attaches BclI site to 5' end of CH2 domain of IgE)
                                        (SEQ ID NO: 588)
5'-gttgttgatcacgtctgctccagggacttcacc-3'

3' primer: (attaches stop codon and XbaI site to 3' end of CH4 of IgE)
                                        (SEQ ID NO: 589)
5'-gttgtttctagattatcatttaccaggatttacagacaccgctcgctg-3'

3' primer: (attaches SfuI and BamHI to 3' end of CH4 without a stop codon)
                                        (SEQ ID NO: 590)
5'-gttgttttcgaaggatccgctttaccagatttacagacaccgctcgctg-3'
```

The IgE CH2CH3CH4 tail with a stop codon was digested with BclI and XbaI and inserted into a pD18 vector that contains 2H7 VHL11S scFv. This construct was designated 2H7 IgECH2CH3CH4. The polynucleotide sequence is provided in SEQ ID NO:128, and the encoded polypeptide sequence is provided in SEQ ID NO:96. The IgE CH2CH3CH4 tail with no stop codon (ORF) was digested with BclI and SfuI and inserted in into a pD18 vector that contains 2H7 VHL11S scFv. This construct was designated 2H7 IgECH2CH3CH4(ORF).

The human IgE was also amplified as a fragment missing both CH1 and CH2 domains, with only the CH3 and CH4 domains attached to the human IgG1 hinge. Sequential PCR reactions using overlapping 5' oligonucleotides were used to attach the IgG1 hinge to the CH3 domain of human IgE. Primers for the first step of the PCR reaction:

```
5' Primer:
                                        (SEQ ID NO: 591)
5'-actcacacatccccaccgtccccagcatccaacccgagaggggtga
gc-3'
```

Primers for the second step of the PCR reaction:

```
5' primer:
                                        (SEQ ID NO: 592)
5'-tctgatcaggagcccaaatcttctgacaaaactcacacatccc
caccg-3'

3' primer:
                                        (SEQ ID NO: 593)
5'-gttgtttctagattatcatttaccaggatttacagacaccgct
cgctg-3'
```

The PCR product was digested with EcoRI and sequenced according to the methods described in Example 1. Positive clones were inserted into pD18 plasmid containing 2H7 VHL11S scFv (SSS-S) H. The construct was designated 2H7 VHL11S scFv (SSS-S) H IgE CH3CH4. The polynucleotide sequence is provided in SEQ ID NO:227, and the encoded polypeptide sequence is provided in SEQ ID NO:228.

Binding capacity of 2H7 scFv VH L 11S IgECH2 CH3 CH4, was measured using flow cytometry, essentially according to Example 2. The protein was purified using MEP Hyper-Cel, (Cipergen, Catalog #12035-010, Lot#200920/0271) chromatography resin and Hydrophobic Charge Induction Chromatography (HCIC). HCIC absorbent is a high capacity, high selectivity, absorbent designed for capture and purification of monoclonal and polyclonal antibodies from various sources including cell culture supernatants. Columns were packed with a 10 ml bead volume of MEP Hypercel, and equilibrated with PBS, pH 7.4 containing 0.1% NaN3. Approximately 1 liter of 2H7 scFv VHL11S IgE CH2CH3CH4 CHO culture supernatant was then run over the column. A series of citrate buffers ranging from pH 3-6 were prepared for elution of the fusion protein. The column was washed in PBS. Protein was eluted in fifteen 1 ml fractions at pH6, 5, and 4. A final 15 ml fraction was collected at pH 3.5. Aliquots from each fraction were analyzed for A280 and were also subjected to SDS-PAGE, loading roughly 10 micrograms/well based on the A280 reading. The results of these two analyses indicated that the bulk of the protein did not elute in citrate buffers at the higher pH, but eluted at pH4, and the post elution wash at pH3.5 also contained significant amounts of protein.

The ability of these 2H7 VH L11S IgE purified proteins to bind CD20+CHO cells was determined using flow cytometry according to the methods described in Example 2 using FITC-conjugated goat-anti-human IgE. FIG. 58A illustrates that both purified proteins are able to bind CD20+CHO cells.

The ability of these 2H7 VH L11S IgE purified proteins to mediate ADCC against BJAB target cells with PBMC effectors was measured according to the methods described in Example 2. FIG. 58B illustrates that both proteins were able to mediate ADCC at similar levels.

Example 39

Construction and Binding Capacity of scFv VH L11S Mutants with Mouse IgA and IgE Tail Regions Murine IgA was cloned from murine spleen RNA using essentially the same methods used to clone the human IgE tails in Example 38. The PCR reactions were performed with a 94 C 60 sec; 52 C 60 sec; 72 C 2 min amplification profile for 35 cycles. The PCR primers used to clone CH1-CH4 regions were:

```
5' primer:
                                           (SEQ ID NO: 594)
5'-atctgttctcctcctactactcctcctccacct-3'

3' primer:
                                           (SEQ ID NO: 595)
5'-tcagtagcagatgccatctccctctgacatgatgacagacacgc
t-3'
```

PCR primers used to delete the CH1 region:

```
5' primer:
                                           (SEQ ID NO: 596)
5'-gttgttgatcacatctgttctcctcctactactcctcctccacct-3'

3' primer with a stop codon, XbaI site at end of Ig tail, and the T4 mutation in
CH3 region:
                                           (SEQ ID NO: 597)
5'-gttgtttctagattatcaatctccctctgacatgatgacagacac-3'

3' primer for the ORF, a SfuI and BamHI sites, and T4 mutation in the CH3 region:
                                           (SEQ ID NO: 598)
5'-gttcttcgaaggatccgcatctccctctgacatgatgac-3'
```

The mouse IgACH2 T4-CH3 tail with a stop codon was digested with BclI and XbaI and inserted into a pD18 vector that contains 2H7 VHL11S scFv and the IgAH. This construct was designated 2H7 VHL11S scFv IgAH mIgACH2 T4-CH3. The polynucleotide sequence is provided in SEQ ID NO:253, and the encoded polypeptide sequence is provided in SEQ ID NO:25.

The mouse IgACH2 T4-CH3 tail with no stop codon (ORF) was digested with BclI and SfuI and inserted in into a pD18 vector that contains 2H7 VHL11S scFv and IgAH. This construct was designated 2H7 VHL11S scFv IgAH mIgACH2 T4-CH3 (ORF). The polynucleotide sequence is provided in SEQ ID NO:255, and the encoded polypeptide sequence is provided in SEQ ID NO:256.

Murine IgE was cloned murine IgE La2 (ATCC) RNA essentially according the methods described in Example 38. The PCR reactions were performed with a 94 C 60 sec; 52 C 60 sec; 72 C 2 min amplification profile for 35 cycles. Initial PCR primers used to clone the CH1-CH4:

```
5' primer:
                                           (SEQ ID NO: 599)
5'-tctatcaggaaccctcagctctaccccttgaagccctg-3'

3' primer:
                                           (SEQ ID NO: 600)
5'-gttgtttctagattatcaggatggacggagggaggtgttaccaa
ggct-3'
```

PCR primers to remove the CH1 region:

```
5' primer:
                                           (SEQ ID NO: 601)
5'-gttgttgatcacgttcgacctgtcaacatcactgagcccacc-3'

3' primer with stop codon and XbaI site:
```

```
                                                                        (SEQ ID NO: 602)
5'-gttgtttctagattatcaggatggacggagggaggtgttaccaaggct-3'

3' primer ORF, SfuI and Bam HI:
                                                                        (SEQ ID NO: 603)
5'-gttgttttcgaaggatccgcggatggacggagggaggtgtta-3'
```

The mouse IgE CH2CH3CH4 tail with a stop codon was digested with BclI and XbaI and inserted into a pD18 vector that contains 2H7 VHL11S scFv. This construct was designated 2H7 VHL11S mIgECH2CH3CH4. The polynucleotide sequence is provided in SEQ ID NO:249, and the encoded polypeptide sequence is provided in SEQ ID NO:250.

The mouse IgE CH2CH3CH4 tail with no stop codon (ORF) was digested with BclI and SfuI and inserted in into a pD18 vector that contains 2H7 VHL11S scFv. This construct was designated 2H7 VHL11S scFv mIgECH2CH3CH4 (ORF). The polynucleotide sequence is provided in SEQ ID NO:249, and the encoded polypeptide sequence is provided in SEQ ID NO:250.

Binding capacity of 2H7 VH L11S mIgE and mIgA (with mouse tail regions) to CD20+CHO cells were also measured by flow cytometry according to the methods described in Example 2 using commercially available IgE or IgA second step reagents (Caltag). Each point in FIG. 59 represents the mean of a population with brightness corrected by subtracting the binding of the second step alone. This figure illustrates that these constructs have the ability to bind CD20+CHO cells.

Example 40

HPLC Profiles of 2H7 scFv Ig Mutant Fusion Proteins

HPLC analysis of purified 2H7 scFv-Ig mutant fusion proteins with altered connecting and CH3 regions. Each protein was purified by Protein A affinity chromatography from supernatants of transfected COS or CHO cells. Twenty-five to fifty micrograms of each sample was run at 1 ml/min in PBS on a TSK-GEL G3000SW$_{XL}$ 30 cm column (Tosoh Biosep, Stuttgart, Germany). The arrow near the beginning of each profile represents the sample injection point. Gel filtration standards (Bio-Rad) included thryoglobulin (670 kDa), gamma globulin (158 kDa), ovalbumin (44 kDa), myoglobin (12.5 kDa), and vitamin B-12 (1.35 kDa). Standards were run at the beginning and end of each experiment. Migration positions of standards are shown and did not vary between experiments. (FIGS. 60-62)

Example 41

Binding Capacity of 2H7 VH L11S Mutant Fusion Proteins

Binding effects of the CH3 mutant were compared to the non-mutated CH3 fusion protein. The constructs were transfected into COS cells and purified from the supernatant using protein A column purification techniques described in Example 2. FIG. 63 illustrates the differential effects of CH3 mutations on binding using flow cytometry according to the methods described in Example 2. This figure illustrates that some binding ability is lost when the double point mutation is introduced in the CH3 region.

Binding of fluorescein isothiocyanate (FITC) conjugated 2H7 VH L11S mutant fusion proteins was determined using flow cytometry. A 1 mg/ml solution of FITC was prepared in DMSO. Fusion proteins were dialyzed in pH 9.3 bicarbonate buffer overnight at 4 C in a volume of 2 liters. Concentration of the protein was adjusted to 1-5 mg/ml prior to conjugation. A series of Falcon 5 ml tubes was set up with varying FITC to protein ratios, ranging from 15-60, but minimally ratios of 20 and 40. Conjugation reactions were incubated at 37 C for 30 minutes protected from light. Fluoresceing labeled protein was separated from free fluorescein on a 2 ml Sephadex G-25 column equilibrated with PBS, 0.5 M NaCl, and 1% NaN3. The fluorescein labeled protein eluted from the column first and was collected in a 5 ml tube. The degree of labeling was determined by measuring the absorbance of the diluted conjugate at 280 and 494 nm, and utilizing the formulas provided by technical services at Molecular Probes (Eugene, Oreg.). Data has been corrected for FITC: protein ratio. FIG. 64 illustrates that these constructs do not lose binding capacity when conjugated to a fluorescent marker.

Purified 2H7 VH L11S constructs were run on a non-reducing SDS gel according to the methods described in Example 2. The migration patterns are presented in FIG. 65.

Example 42

Characterization of 2H7 scFv VH L11S (CSC-S) H WCH2 WCH3 in Lec13 CHO Cells

2H7 scFv VH L11S (CSC-S) H WCH2 WCH3 were transiently transfected and expressed in Lec13 CHO cells. Lec13CHO cells were used as the mammalian cell hosts for either the 2H7 scFv VHS11 hIgG1 (CSS-S) H WCH2 WCH3 and (CSC-S) H WCH2 WCH3 expressing plasmids in side-by-side transfections. All transfections were performed in 100 mm tissue culture dishes. Cells were transfected when approximately 90% confluent using lipofectamine 2000 (Invitrogen, Catalog #: 11668-027, 0.75 ml), following manufacturer's instructions. Both cell lines were grown in the presence of serum to promote and maintain adherence to the cell culture dishes, simplifying transfection manipulations, washes, and supernatant harvests. DNA: lipofectamine complexes were allowed to form in the absence of serum and antibiotics, following the suggested protocol/conditions recorded in the product insert. Culture supernatants were harvested 72 hours after transfection, and then again 72 hours after the first harvest. Fusion protein from the two CHO sources was isolated by protein A purification as previously described and used in CD20 binding and ADCC assays.

The ability of mutated fusion protein to mediate ADCC in CD20 positive cells was determined using the methods described in Example 2. Constructs expressed in Lec13 CHO cells exhibited better binding to CD20 CHO target cells and also showed significantly improved activity in ADCC assays relative to the CHO DG44 derived proteins at equivalent concentrations as illustrated in FIG. 67.

Example 43

Construction of High and Low Affinity CD16 Alleles

The low(V) and high(F) affinity alleles at position 158 of the human CD16 extracellular domain were cloned from cDNA derived from human PBMC using PCR assay. PCR reactions used random primed cDNA made from PBMC stimulated for 3 days with immobilized anti-CD3 antibody (64.1) prior to harvest. PCR reactions included 2, 4, 6 or 8 microliters of cDNA, each primer at 25 pmol, and an amplification profile of 94 C 60 sec; 55 C 60 sec; 72 C 2 min, for 35 cycles. The PCR primers are listed below:

```
5' primer-no leader peptide:
                                    (SEQ ID NO: 604)
5'-GTTGTTACCGGTGCAATGCGGACTGAAGATCTCCC
AAAGGCTGTG-3'

3' antisense primer:
                                    (SEQ ID NO: 605)
5'-GTTGTTTGATCAGCCAAACCTTGAGTGATGGTGATGTTCACA-3'
```

Positive clones were sequenced, and inserted into a vector containing an efficient leader peptide and the (SSS-S)H P238SCH2 WCH3 human IgG tail. Two different versions of the CD16 ED fusion proteins were expressed. The first contained the F158 (high affinity) and the second contained the V158 (low affinity) allele. Constructs were cloned into a (SSS-S)H P238S CH2 WCH3 pD18 plasmid and expressed in COS and CHO cells as previously described in examples 1 and 10. CHO clones were screened for expression using an IgG sandwich ELISA to determine relative expression levels of the fusion proteins in the culture supernatant using the following protocol: Immulon 1V plates were coated at 4 C with 0.4 microgram/ml goat anti-human IgG (mouse Adsorbed), (CalTag, Catalog #H10500) in PBS buffer. Plates were then blocked in PBS/1.5% nonfat milk at 4 C overnight. Plates were washed three times in PBS/0.1% Tween 20, then incubated with 100 microliters dilution series from CHO clone culture supernatants at room temperature for 3 hours. Four dilutions per clone were added to successive wells, diluting in 5 fold increments from 1:5 to 1:375. In addition a standard curve was derived using CTLA4 hIgG1 (SSS-S)H P238SCH2 WCH3 as a concentration standard. The dilution series utilized 5 fold dilutions starting at 0.5 micrograms/ml; a second set of 8 wells was used to make a 2-fold dilution series starting at 0.34 micrograms/ml. Plates were washed 3 times in PBS/0.1% Tween 20, and incubated with goat anti-human IgG, conjugated to horseradish peroxidase (GAH IgG-HRP) at 1:5000, in PBS/0.5% BSA for 1 hour. Plates were washed four times with PBS/0.1% Tween 20, then TMB chromagen substrate (BD-Pharmingen) was added for 10 minutes, and reactions stopped by addition of 100 microlites 1N sulfuric acid. Plates were then read at 415 nm on a SpectraCount plate reader. Concentrations of fusion protein were estimated by comparison of the ODs in the linear range to the CTLA4Ig standard curve run on each plate.

Proteins were purified using Protein A purification and were directly conjugated to fluorescein isothiocyanate (FITC) as described in Example 42. These proteins were run out on SDS gels under reduced and nonreduced conditions according to the methods described in Example 2. The migration of these proteins is presented in FIG. 68.

The ability of the high and low CD16 alleles to bind 2H7 VH111S(CSC-S) H WCH2 WCH3 or bind 2H7 VH111S (SSS-S) H (P238S)CH2 WCH3 expressed on the cell surface of CD20+CHO target cell is determined using flow cytometry according to the methods described in Example 2. The results in FIG. 69 demonstrate both the high and low affinity alleles were able to bind 2H7 VHL11S (CSC-S)H WCH2 WCH3 (SEQ ID NO:246) and lost some binding capabilities when the P238S mutation was introduced into the CH2 region of the construct (SEQ ID NOs:417 and 418).

Example 44

Mammalian Display System

FIG. 70A diagrams how FITC conjugates of FcRIII (CD16) Soluble Fusion proteins bind to 2H7 scFv-Ig constructs that are attached to CD20 expressed by CHO cells. The CD16 binding to a scFv-Ig provides a screening tool for detecting changes in CD16 binding to an altered scFv-Ig constructs containing targeted or site-specific mutations. Changes in CD16 binding properties may be changes in binding of either CD16 high affinity protein (158 F) or CD16 low affinity protein (158 V) or both.

A schematic representation of such a screening process is diagrammed in FIG. 70B, where scFv-Ig constructs are displayed on the cell surface of mammalian cells. The scFv-Ig molecules in this Example are displayed on the cell surface because they contain a transmembrane domain anchor. These molecules may represent a single scFv-Ig construct or may be introduced into a population of mammalian cells as a library of such molecules. Transfected cells with altered binding properties can then be panned, sorted, or otherwise isolated from other cells by altering the stringency of the selection conditions and using CD16 fusion proteins as the binding probe. Cells that express scFv-Ig molecules with altered binding to either CD16 high affinity allele (158 F) or CD16 low affinity allele (158V) or both can be isolated. For example, this display system can be used to create a library of mutated Ig tails with short stretches of CH2 sequence replaced with randomized oligonucleotides or possibly randomization of a single residue with all possible amino acid substitutions, including synthetic amino acids. Once such a library is constructed, it can be transfected into COS cells by methods well known in the art. Transfectants can then be bound to the labeled CD16 constructs, and panned or sorted based on their relative binding properties to multiple allelotypes/isoforms. Panned cells are harvested, and the plasmid DNA is isolated and then transformed into bacteria. This process may be repeated iteratively multiple times until single clones are isolated from the mammalian host cells (see Seed B and Aruffo A, PNAS 84:3365-3369 (1987) and Aruffo A and Seed B, PNAS 84: 8573-8577 (1987)). One such use of this type of screening system would be to isolate Ig tails which bind equally well to both the high and low affinity alleles of CD16 with the goal of improving effector functions mediated by scFv-Ig constructs in multiple subpopulations of patients. Ig tails with altered binding properties to other Fc receptors can also be selected using the display system described. Other display systems for example those that use bacteriophage or yeast are not suitable for selection of Ig tails with altered FcR binding properties because of the requirement for glycosylation in the Ig CH2 domain that would not occur in non-mammalian systems.

This system is also useful for selection of altered scFv-Ig molecules that will be produced at higher levels. In this Example, mammalian cells such as COS cells can be transfected with a library of scFv-Ig constructs in a plasmid that directs their expression to the cell surface. COS cells that express the highest levels of the scFv-Ig molecules can be selected by techniques well known in the art (for example panning, sterile cell sorting, magnetic bead separation, etc), and plasmid DNA is isolated for transformation into bacteria. After several rounds of selection single clones are isolated that encode scFv-Ig molecules capable of high level expression. When the isolated clones are altered to remove the membrane anchor and then expressed in mammalian cells, the scFv-Ig constructs will be secreted into the culture fluid in high levels. This reflects the common requirement of secreted glycoproteins and cell surface glycoproteins for a signal peptide and processing through the golgi for expression, so that selection for a molecule that illustrates an improvement in expression levels on the cell surface will also select for a molecule that illustrates an improvement in levels of secreted protein.

Example 45

Characterization of G28-1 mAbs and scFvs

Ability of G28-1 mAbs and scFvs to induce apoptosis was measured by binding Annexin V, using the methods described in Example 3. The results in FIG. 71 demonstrate that the Annexin V binding of G28-1 antibodies and scFv is increased when treated together with 2H7 antibodies and scFv constructs.

Example 46

Construction of FC2-2 scFv Constructs

Contrstruction of the FC2-2 (anti-CD16) scFv was performed using total RNA isolated from the FC2-2 hybridoma and cloned using methods described in Example 35. The polynucleotide sequence is provided in SEQ ID NO:337, and the encoded polypeptide sequence is provided in SEQ ID NO:338. The specific primers for the secondary PCR reaction are listed bellow. The following are primers for the light chain variable region:

```
5' primer with HindIII site with no leader:
                               (SEQ ID NO: 606)
5'-GTTGTTAAGCTTGCCGCCATGGATTCAC
AGGCCCAGGTTCTT-3'

5' primer with SalI site and leader:
                               (SEQ ID NO: 607)
5'-GTTGTTGTCGACATTGTGATGTCACAGTCTCC
ATCCTCCCTA-3'

3' primer:
                               (SEQ ID NO: 608)
5'-TCAGTGCTGATCATGAGGAGACGGTGACTGAGGTTCCT-3'
```

The following are primers for the heavy chain variable region:

```
5' primer:
                               (SEQ ID NO: 609)
5'-TCGGGCGGTGGTGGGTCGGGTGGCGGCGGATCGTCACAGGTGCAGTT
GAAGGAGTCAGGA-3'

3' primer:
                               (SEQ ID NO: 610)
5'-ACCCGACCCACCACCGCCCGAGCCACCGCCACCTTTTATTTCCAGCT
TGGTGCCACCTCCGAA-3'
```

A change from leucine to serine at position 11 in the heavy chain variable region (Kabat numbering) was introduced in into the FC2-2 scFv by site-directed mutagenesis according to the methods described in Example 33. The scFv was attached to the (SSS-S) H WCH2 WCH3 IgG tail according to methods described in Example 33. The mutant is designated FC2-2 scFv VH L11S (SSS-S) H WCH2 WCH3. The polynucleotide sequence is provided in SEQ ID NO:345, and the encoded polypeptide sequence is provided in SEQ ID NO:346.

Example 47

Construction of 5B9 scFv Constructs

Contrstruction of the 5B9 (anti-CD137) scFv was performed using total RNA isolated from the 5B9 hybridoma and cloned using methods described in Example 35. The polynucleotide sequence is provided in SEQ ID NO:361, and the encoded polypeptide sequence is provided in SEQ ID NO:362. The specific primers for the secondary PCR reaction are listed bellow. The following are primers for the light chain variable region:

```
5' primer with HindIII site with no leader:
                               (SEQ ID NO: 611)
5'-GTTGTTAAGCTTGCCGCCATGAGGTTCT
CTGCTCAGCTTCTG-3'

5' primer with SalI site and leader:
                               (SEQ ID NO: 612)
5'-GTTGTTGTCGACATTTGTGATGACGCAGGCTG
CATTCTCCAATT-3'

3' primer:
                               (SEQ ID NO: 613)
5'-TCAGTGCTGATCAGAGGAGGACGGTGACTGAGGTTCCTTG-3'
```

The following are primers for the heavy chain variable region:

```
5' primer:
                               (SEQ ID NO: 614)
5'-CGGGCGGTGGTGGGTCGGGTGGCGGCGGATCGTCACAGGTGCAGCTG
AAGCAGTCAGGA-3'

3' primer:
                               (SEQ ID NO: 615)
5'-CCCGACCCACCACCGCCCGAGCCACCGCCACCCTTCAGCTCCAGCTT
GGTGCCAGCACC-3'
```

A change from leucine to serine at position 11 in the heavy chain variable region (Kabat numbering) was introduced in into the 5B9 scFv by site-directed mutagenesis and attached to (SSS-S) H WCH2 WCH3 according to the methods described in Example 33. This construct was designated 5B9 scFv VH L11S (SSS-S) H WCH2 WCH3. The polynucleotide sequence is provided in SEQ ID NO:365, and the encoded polypeptide sequence is provided in SEQ ID NO:366.

Example 48

Construction of UCHL1 scFv Constructs

Contrstruction of the UCHL1 (anti-CD45RO) scFv was performed using total RNA isolated from the UCHL1 hybridoma and cloned using methods described in Example 35 The polynucleotide sequence is provided in SEQ ID NO:351, and the encoded polypeptide sequence is provided in SEQ ID NO:352. The following are primers for the light chain variable region:

```
5' primer with HindIII site:
                                 (SEQ ID NO: 616)
5'-GTTGTTAAGCTTGCCGCCATGAAGTTGCCTGTTAGGCTG
TTGGTGCTG-3'

3' primer with Sac site:
                                 (SEQ ID NO: 617)
5'-AGAGCTCCCACCTCCTCCAGATCCACCACCGCCCGAGCCAC
CGCCATCTTTGATTTCCAGCTTGGT-3'
```

The following are primers for the heavy chain variable region:

```
5' primer:
                                 (SEQ ID NO: 618)
5'-TTTCAGAGTAATCTGAGAGCTCCCACCTCCTCCAGATCCACCACCGC
CCGA-3'

3' primer:
                                 (SEQ ID NO: 619)
5'-TCAGTGCTGATCATGCAGAGAGACAGTGACCAGAGTCCC-3'
```

A change from leucine to serine at position 11 in the heavy chain variable region (Kabat numbering) was introduced in into the 5B9 scFv by site-directed mutagenesis and connected to a (SSS-S) HWCH2 WCH3 according to the methods described in Example 33. The mutant is designated UCHL1 scFv VH L11S (SSS-S) H WCH2 WCH3. The polynucleotide sequence is provided in SEQ ID NO:359, and the encoded polypeptide sequence is provided in SEQ ID NO:360.

Example 49

L6 VHL11S scFv (SSS-S) H WCH2 WCH3

A change from leucine to serine at position 11 in the heavy chain variable region (Kabat numbering) was introduced in into the L6 scFv (SSS-S) H WCH2 WCH3 (constructed according to methods described in Example 106) by site-directed mutagenesis according to the methods described in Example 33. The L6scFvIg (SSS-S) H WCH2 WCH3 pD18 plasmid was used as template. Positive clones were inserted into the pD18 plasmid containing (SSS-S) H WCH2 WCH3 according to methods described in Example 33. The mutant is designated L6 scFv VH L11S (SSS-S) H WCH2 WCH3. The polynucleotide sequence is provided in SEQ ID NO:415, and the encoded polypeptide sequence is provided in SEQ ID NO:416. PCR primers are listed bellow:

```
5' Primer with PstI restriction site:
                                 (SEQ ID NO: 620)
5'-ggcggatctctgcagatccagttggtgcagtctggacctgagtcga
agaagcctggagag-3'

3' Primer:
                                 (SEQ ID NO: 621)
5'-ggacagtgggagtggcacc-3'
```

Example 50

Construction of HD37 scFv VHL11S Construct

A change from leucine to serine at position 11 in the heavy chain variable region (Kabat numbering) was introduced in into the HD37 scFv by site-directed mutagenesis according to the methods described in Example 33. The HD37 scFv (SSS-S)H WCH2 WCH3 pD18 plasmid was used as a template. Positive clones were inserted into the pD18 plasmid containing (SSS-S) H WCH2 WCH3 according to methods described in Example 33. The mutant is designated HD37 scFv VH L11S (SSS-S) H WCH2 WCH3. The polynucleotide sequence is provided in SEQ ID NO:401, and the encoded polypeptide sequence is provided in SEQ ID NO:402. PCR primers are listed bellow:

```
5' primer:
                                 (SEQ ID NO: 622)
5'-caggttcagctgcagcagtctggggctgagtcggtgaggcctgg-3'

3' primer:
                                 (SEQ ID NO: 623)
5'-ggaggattcgtctgcagtcagagtggc-3'
```

Example 51

2H7 scFv VHL11S Constructs

Additional 2H7 VHL11S constructs were made with different connecting regions. The pD18 2H7 scFv VHL11S (SSS-S) H WCH2 WCH3 vector was digested with BclI and XbaI to remove the connecting region, CH2 and CH3. Theses were replaced with each different connecting region, CH2 and CH3 according to the methods described in Example 13. The new constructs were designated: 2H7scFv VHL11S (CSS-S) H WH2 WH3 (SEQ ID NO:371), 2H7scFv VHL11S (CSC-S) H WH2 WH3 (SEQ ID NO:245). 2H7 scFv VHL11S was also attached to an IgA connecting region, CH2, CH3 and an IgE CH2, CH3, CH4. The pD18 2H7 scFv VHL11S (SSS-S) H WCH2 WCH3 plasmid was digested using methods above to remove the connecting region CH2, and CH3. The IgA regions were inserted using methods described in Example 13. The construct was designated 2H7 scFv VHL11S IgAH IgACH2 T4CH3 (SEQ ID NOs:251 and 253). The IgE CH2 CH3 CH4 region was inserted into the digested pD18 vector above using methods described in Example 39. The construct was designated 2H7 scFv VHL11S IgECH2 CH3 CH4 (SEQ ID NO:247).

Example 52

2H7 scFv VH L11S (CSC-S) H WCH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a human IgG1 connecting region, CH2 and CH3 region, where in the second cysteine and the proline in the connecting region have been changed to serines (SSS-S) as described in Example 32. The polynucleotide sequence is provided in SEQ ID NO:245, and the encoded polypeptide sequence is provided in SEQ ID NO:246.

Example 53

2H7 scFv VH L11S IgE CH2 CH3 CH4

This construct has a 2H7 (anti-CD20) single chain Fv binding region with a point mutation at amino acid residue 11 in the heavy chain variable region, where the leucine has been changed to a serine, as described in Example 33. This binding region is attached to a human IgE constant region containing CH2, CH3 and CH4 as described in Example 38. The polynucleotide sequence is provided in SEQ ID NO:247, and the encoded polypeptide sequence is provided in SEQ ID NO:248.

Example 54

2H7 scFv VH L11S mIgE CH2 CH3 CH4

This construct has a 2H7 (anti-CD20) single chain Fv binding region with a point mutation at amino acid residue 11 in the heavy chain variable region, where the leucine has been changed to a serine, as described in Example 33. This binding region is attached to a mouse IgE constant region containing CH2, CH3 and CH4 as described in Example 39. The polynucleotide sequence is provided in SEQ ID NO:249, and the encoded polypeptide sequence is provided in SEQ ID NO:250.

Example 55

2H7 scFv VH L11S mIgAH WIgACH2 T4CH3

This construct has a 2H7 (anti-CD20) single chain Fv binding region with a point mutation at amino acid residue 11 in the heavy chain variable region, where the leucine has been changed to a serine, as described in Example 33. This binding region is attached to a connecting region from human IgA as described in Example 5. This connecting region is attached to a mouse IgA constant region consisting of a wild type CH2 region and a mutated CH3 region where there is a truncation of 4 amino acid residues prior to the 3' stop codon as described in Example 39. The polynucleotide sequence is provided in SEQ ID NO:253, and the encoded polypeptide sequence is provided in SEQ ID NO:254.

Example 56

2H7 scFv VH L11S (SSS-S) H K322S CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG connecting region where all of the cysteines and one proline have been changed to serines (SSS-S) according to methods described in Example 5. The connecting region is attached to a mutated IgG CH2 region and a wild type IgG CH3 region. The K322S mutation in the CH2 region is at a residue 322, where a Lysine has been changed to a serine using overlapping PCR assay. An (SSS-S) H WCH2 WCH3 IgG1 template in the pD18 vector was used for PCR amplification, to create (SSS-S) H derivatives containing these CH2 mutations. PCR reactions used a cycling profile of 94 C, 30 sec; 55 C, 30 sec; 72 C, 30 sec, for 37 cycles to complete the reactions. This IgG1 derivative was constructed by using sequential PCR reactions with overlapping oligonucleotides in the primary and secondary reactions. The primary amplification primers introduced the mutation(s), but deleted one end of the Fc domain. Secondary reaction primers reattached these ends using overlapping primers. The first overlapping primer was added at the beginning of the PCR, the reactions allowed to proceed for 12 cycles, paused and then the second overlapping primer added to the reactions followed by 25 more cycles to complete the overlap extension PCR reactions.

Primers for the first PCR reaction:

```
5' Primer:
                                     (SEQ ID NO: 624)
5'-ggagatggttttctcgatgggggctgggagggcttt
gttggagaccgagcacttgtactcc-3'

3' primer:
                                     (SEQ ID NO: 625)
5'-ggacagtgggagtggcacc-3'
```

PCR products were cloned into TOPO vector and sequenced for verification. Positive vectors were used as templates for the second overlapping PCR reaction.

```
5' primer:
                                     (SEQ ID NO: 626)
5'-ccgtctctgatcaggagcccaaatcttctgacaaaa
ctcacacatccccaccgtccccagc-3'

5' primer overlapping primer:
                                     (SEQ ID NO: 627)
5'-tccccaccgtccccagcacctgaactcctgggggga
tcgtcagtcttcctcttccccccaaaacc-3'

3' primer:
                                     (SEQ ID NO: 628)
5'-caggaaacagctatgac-3'
```

PCR product was cloned into TOPO vector and sequenced. The polynucleotide sequence is provided in SEQ ID NO:263, and the encoded polypeptide sequence is provided in SEQ ID NO:264.

Example 57

2H7 scFv V11 L11S (CSS-S) H K322S CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is attached to a mutant IgG connecting region, where the second and third cysteines have been changed to serines and the proline has been changed to serine (CSS-S), according to methods described in Example 13. The connecting region is attached to a mutated IgG CH2 region and a wild type IgG CH3 region. The K322S mutation in the CH2 region is at a residue 322, where a Lysine has been changed to a serine using overlapping PCR assay. region is attached to a mutated IgG CH2 region and a wild type IgG CH3 region. The mutation in the CH2 region was added by overlapping PCR reaction essentially according to Example 57, with (CSS-S) H WCH2 WHC3 IgG1 pD18 vector as a template in the first PCR reaction and different primers in the second PCR reaction, which are listed below.

```
5'primer:
5'-ccgtctctgatcaggaccccaaatcttgtgacaa  (SEQ ID NO:
                                             629)
aactcacacatccccaccgtccccagc-3'

5'overlapping primer:
5'-tccccaccgtccccagcacctgaactcctggggg
```

-continued

```
atcgtcagtcttcctcttcccccaaaacc-3'
(SEQ ID NO: 630)

3'primer:
5'-caggaaacagctatgac-3'          (SEQ ID NO:
                                  628)
```

PCR products were cloned into the TOPO vector and sequenced. The polynucleotide sequence is provided in SEQ ID NO:267, and the encoded polypeptide sequence is provided in SEQ ID NO:268.

Example 58

2H7 scFv VH L11S (SSS-S) H P331S CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG1 connecting region where all of the cysteines and one proline have been changed to serines (SSS-S) according to methods described in Example 5. The connecting region is attached to a mutated IgG1 CH2 region and a wild type IgG1 CH3 region. The mutation P331S mutation in the CH2 region, where the proline at residue 331 has been changed to a serine, was incorporated using a single PCR reaction, using a (SSS-S) H WCH2 WCH3 pD18 template and a cycling profile of 94 C, 30 sec; 55 C, 30 sec; 72 C, 30 sec, for 37 cycles. The specific primers for reaction are listed below.

```
5' primer:
5'ccgtctctgatcaggagcccaaatcttctgacaaaac (SEQ ID NO:
                                          631)
tcacacatccccaccgtccccagc-3'

3' Primers:
5'-gcagggtgtacacctgtggttctcggggctgccctt (SEQ ID NO:
                                          632)
tggctttggagatggttttctcgatggaggctggg agg-3'
```

The polynucleotide sequence is provided in SEQ ID NO:273, and the encoded polypeptide sequence is provided in SEQ ID NO:274.

Example 59

2H7 scFv V11 L11S (CSS-S) H P331S CH2 WCH3

This binding region is attached to a mutant IgG connecting region, where the second and third cysteines have been changed to serines and the proline has been changed to serine (CSS-S), according to methods described in Example 13. The connecting region is attached to a mutated IgG CH2 region and a wild type IgG CH3 region. The mutation P331S mutation in the CH2 region, where the proline at residue 331 has been changed to a serine, was incorporated using a single PCR reaction, using a (CSS-S) H WCH2 WCH3 pD18 template and a cycling profile of 94 C, 30 sec; 55 C, 30 sec; 72 C, 30 sec, for 37 cycles. The specific primers for reaction are listed below.

```
5'primer:
5'-ccgtctctgatcaggaccccaaatcttgtgacaaaa (SEQ ID NO:
                                          633)
ctcacacatccccaccgtccccagc-3'

3'Primer:
5'-gcagggtgtacacctgtggttctcggggctgccctt (SEQ ID NO:
                                          634)
tggctttggagatggttttctcgatggaggctggg agg-3'
```

The polynucleotide sequence is provided in SEQ ID NO:275, and the encoded polypeptide sequence is provided in SEQ ID NO:276.

Example 60

2H7 scFv VH L11S (SSS-S) H T256N CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG connecting region where all of the cysteines and one proline have been changed to serines (SSS-S) according to methods described in Example 5. The connecting region is attached to a mutated IgG CH2 region and a wild type IgG CH3 region. The T256N mutation in the CH2 region, the threonine at residue 256 has been changed to an asparagine, using the overlapping PCR methods described in Example 56. The specific primers are listed below.

Primers for the first PCR reaction:

```
5' primer:
5'ttcctcttcccccaaaacccaaggacaccctcatga (SEQ ID NO:
                                         635)
tctcccggaaccctgaggtcac-3'

3' primer:
5'-ggacagtgggagtggcacc-3'        (SEQ ID NO:
                                  636)
```

PCR product cloned into TOPO vector and sequenced. This product was used as the template in the second PCR reaction. Primers for the second PCR reaction:

```
5'primer:
5'ccgtctctgatcaggagcccaaatcttctgacaaaac (SEQ ID NO:
                                          637)
tcacacatccccaccgtccccagc-3'

5'overlapping primer:
5'-tccccaccgtccccagcacctgaactcctgggggga (SEQ ID NO:
                                          638)
tcgtcagtcttcctcttcccccaaaacc-3'

3'primer:
5'-caggaaacagctatgac-3'          (SEQ ID NO:
                                  628)
```

Example 61

2H7 scFv VH L11S (SSS-S) H RTPE/QNAK (255-258) CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG connecting region where all of the cysteines and one proline have been changed to serines (SSS-S) according to methods described in Example 5. The connecting region is attached to a mutated IgG CH2 region and a wild type IgG CH3 region. The RTPE/QNAK mutation in the CH2 region, where residues 255-258 have been mutated from arginine, threonine, proline, glutamic acid to glutamine, asparagines, alanine and lysine, respectively, using the overlapping PCR reactions described in Example 56. The specific primers are listed below.

PCR primers for the first PCR reaction:

```
5' primer:
5'-ttcctcttccccccaaaacccaaggacaccctca      (SEQ ID NO:
                                            641)
tgatctcccagaacgctaaggtcacatgc-3'

3' primer:
5'-ggacagtgggagtggcacc-3'                  (SEQ ID NO:
                                            636)
```

The PCR product was cloned into TOPO vector, sequenced and used as a template for the second PCR reaction. The primers for the second PCR reaction:

```
5 primer:
5'ccgtctctgatcaggagcccaaatcttctgacaaaac   (SEQ ID NO:
                                            637)
tcacacatccccaccgtccccagc-3'

5'overlapping primer:
5'-tccccaccgtcccagcacctgaactcctgggggga    (SEQ ID NO:
                                            638)
tcgtcagtcttcctcttccccccaaaacc-3'

3'primer:
5'-caggaaacagctatgac-3'                    (SEQ ID NO:
                                            628)
```

The polynucleotide sequence is provided in SEQ ID NO:289, and the encoded polypeptide sequence is provided in SEQ ID NO:290.

Example 62

2H7 scFv VH L11S (SSS-S) H K290Q CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG1 connecting region where all of the cysteines and one proline have been changed to serines (SSS-S) according to methods described in Example 5. The connecting region is attached to a mutated human IgG1 CH2 region and a wild type human IgG1 CH3 region. The K290Q mutation in the CH2 region, where the Lysine at residue 290 has been changed to a Glutamine, using a single PCR reaction according to the methods described in Example 58. The specific primers used in this reaction are listed below.

```
5' primer:
5'ccgtctctgatcaggagcccaaatcttctgacaaaac   (SEQ ID NO:
                                            642)
tcacacatccccaccgtccccagc-3'

3' primer:
5'-gctcccgcggctgtgtcttggc-3'              (SEQ ID NO:
                                            645)
```

PCR products were cloned into TOPO and sequenced. The polynucleotide sequence is provided in SEQ ID NO:297, and the encoded polypeptide sequence is provided in SEQ ID NO:298.

Example 63

2H7 scFv VH L11S (SSS-S) H A339P CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is connected to a mutated human IgG1 connecting region where all of the cysteines and one proline have been changed to serines (SSS-S) according to methods described in Example 5. The connecting region is attached to a mutated human IgG1 CH2 region and a wild type human IgG1 CH3 region. The A339P mutation in the CH2 region, where the alanine at residue 339 has been changed to a proline, using a single PCR reaction according to the methods described in Example 58. The specific primers used in this reaction are listed below.

```
5' primer:
5'ccgtctctgatcaggagcccaaatcttctgacaaaac   (SEQ ID NO:
                                            644)
tcacacatccccaccgtccccagc-3'

3' Primer:
5'-ggaggtgggcagggtgtacacctgtggttctcgggg   (SEQ ID NO:
                                            647)
ctgccctttgggtttggagatgg-3'
```

PCR products were cloned into TOPO and sequenced. The polynucleotide sequence is provided in SEQ ID NO:305, and the encoded polypeptide sequence is provided in SEQ ID NO:306.

Example 64

G28-1 scFv (SSS-S) H WCH2 WCH3

This construct has a G28-1 (anti-CD37) single chain Fv binding region made according to methods described in Example 35. This binding region is connected to a mutated human IgG1 connecting region where all of the cysteines and one proline have been changed to serines (SSS-S) according to methods described in Example 5. This connecting region is connected to a wild type human IgG1 CH2 and CH3 region as

Example 65

G28-1 scFv IgAH WCH2 WCH3

This construct has a G28-1 (anti-CD37) single chain Fv binding region made according to methods described in Example 35. This binding region is connected to a human IgA connecting region and wild type human IgG CH2 and CH3 constant regions as described in Example 5. This construct has previously been referred to as: G28-1-IgAHWTG1C. The polynucleotide sequence is provided in SEQ ID NO:321, and the encoded polypeptide sequence is provided in SEQ ID NO:322.

Example 66

G28-1 scFv VH L11S (SSS-S) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is connected to a mutated human IgG1 connecting region where all of the cysteines and one proline have been changed to serines (SSS-S) according to methods described in Example 5. This connecting region is attached to wild type human IgG1 CH2 and CH3 region as described in Example 1. The polynucleotide sequence is provided in SEQ ID NO:323, and the encoded polypeptide sequence is provided in SEQ ID NO:324.

Example 67

G28-1 scFv VH L11S(CSS-S) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where the second and third cysteines have been changed to serines and the proline has been changed to serine (CSS-S), according to methods described in Example 13. This connecting region is attached to wild type human IgG1 CH2 and CH3 region as described in Example 1. The polynucleotide sequence is provided in SEQ ID NO:325, and the encoded polypeptide sequence is provided in SEQ ID NO:326.

Example 68

G28-1 scFv VH L11S (CSC-S) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where the second cysteine and the proline has been changed to serine (CSC-S), according to methods described in Example 32. This connecting region is attached to wild type human IgG1 CH2 and CH3 region as described in Example 1. The polynucleotide sequence is provided in SEQ ID NO:327, and the encoded polypeptide sequence is provided in SEQ ID NO:328.

Example 69

G28-1 scFv VH L11S (SSC-P) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where the first and second cysteines have been changed to serines (SSC-P), according to methods described in Example 13. This connecting region is connected to a wild type human IgG1 CH2 and CH3 region as described in Example 1. The polynucleotide sequence is provided in SEQ ID NO:329, and the encoded polypeptide sequence is provided in SEQ ID NO:330.

Example 70

CTLA4 (SSS-S) H P238SCH2 WCH3

This construct has the extra cellular CTLA-4 binding region as described in Example 14. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced using a PCR assay. PCR reactions were performed using random primed cDNA prepared from human tonsil B cell RNA. PCR amplifications used an amplification profile of 94 C 4 min; [94 C 1 min; 55 C 1 min; 72 C 1 min; for 30 cycles followed by a final extension step for 6 minutes at 72 C. PCR fragments were TOPO cloned and clones with EcoRI inserts of approximately 800 bp were sequenced as described in Example 1. The primers used for the PCR are listed below:

```
5' primer:
5'-gttgttgatcaggagcccaaatcttctgacaaaact  (SEQ ID NO:
                                              648)
cacacatctccaccgtccccagcacctgaactcctgggt ggaccgtcagtcttcc-3'

3' primer:
5'gttgtttctagattatcatttacccggagacag-3'    (SEQ ID NO:
                                              649)
```

This construct has previously been referred to as CTLA-4 IgG MTH (SSS) MTCH2WTCH3, which has the same sequence as the above construct. The polynucleotide sequence is provided in SEQ ID NO:331, and the encoded polypeptide sequence is provided in SEQ ID NO:332.

Example 71

CTLA4 (CCC-P) WH WCH2 WCH3

This construct has a CTLA-4 binding region as described in Example 14. This binding region is attached to a wild type human IgG1 connecting region (CCC-P) as described in Example 1. This connecting region is connected to a wild type human IgG1 CH2 and CH3 region as described in Example 1. This construct has previously been referred to as CTLA-4 IgG WTH (CCC) WTCH2CH3, which has the same sequence as the above construct. The polynucleotide sequence is provided in SEQ ID NO:47, and the encoded polypeptide sequence is provided in SEQ ID NO:78.

Example 72

FC2-2 scFv (SSS-S) H WCH2 WCH3

This construct has a FC2-2 (anti-CD16) single chain Fv made according to methods described in Example 46. This binding region is connected to a mutated human IgG1 connecting region where all of the cysteines and one proline have been changed to serines (SSS-S) according to methods described in Example 5. This connecting region is connected to a wild type human IgG1 CH2 and CH3 region as described in Example 1. The polynucleotide sequence is provided in SEQ ID NO:343, and the encoded polypeptide sequence is provided in SEQ ID NO:344.

Example 73

FC2-2 scFv VHL11S (SSS-S) H WCH2 WCH3

This construct has a FC2-2 (anti-CD16) single chain Fv with a point mutation at amino acid residue 11 in the heavy chain variable region, where the leucine has been changed to a serine as described in Example 46. This binding region is connected to a mutated human IgG1 connecting region where all of the cysteines and one proline have been changed to serines (SSS-S) according to methods described in Example 5. This connecting region is connected to a wild type human IgG1 CH2 and CH3 region as described in Example 1. The polynucleotide sequence is provided in SEQ ID NO:345, and the encoded polypeptide sequence is provided in SEQ ID NO:346.

Example 74

UCHL-1 scFv (SSS-S) H WCH2 WCH3

This construct has a UCHL-1 (anti-CD45RO) single chain Fv made according to methods described in Example 48. This binding region is connected to a mutated human IgG1 connecting region where all of the cysteines and one proline have been changed to serines (SSS-S) according to methods described in Example 5. This connecting region is connected to a wild type human IgG1 CH2 and CH3 region as described in Example 1. The polynucleotide sequence is provided in SEQ ID NO:357, and the encoded polypeptide sequence is provided in SEQ ID NO:358.

Example 75

UCHL-1 scFv VHL11S (SSS-S) H WCH2 WCH3

This construct has a UCHL-1 (anti-CD45RO) single chain Fv with a point mutation at amino acid residue 11 in the heavy chain variable region, where the leucine has been changed to a serine as described in Example 48. This binding region is connected to a mutated human IgG1 connecting region where all of the cysteines and one proline have been changed to serines (SSS-S) according to methods described in Example 5. This connecting region is connected to a wild type human IgG1 CH2 and CH3 constant region as described in Example 1. The polynucleotide sequence is provided in SEQ ID NO:359, and the encoded polypeptide sequence is provided in SEQ ID NO:360.

Example 76

5B9 scFv (SSS-S) H WCH2 WCH3

This construct has a 5B9 (anti-CD137) single chain Fv made according to methods described in Example 47. This binding region is connected to a mutated human IgG1 connecting region where all of the cysteines and one proline have been changed to serines (SSS-S) according to methods described in Example 5. This connecting region is connected to a wild type human IgG1 CH2 and CH3 constant region as described in Example 1. This construct has previously been referred to as 5B9 scFv IgG MTH (SSS) WTCH2CH3, which has the same sequence as the above construct. The polynucleotide sequence is provided in SEQ ID NO:132, and the encoded polypeptide sequence is provided in SEQ ID NO:133.

Example 77

5B9 scFv VHL11S (SSS-S) H WCH2 WCH3

This construct has a 5B9 (anti-CD137) single chain Fv with a point mutation at amino acid residue 11 in the heavy chain variable region, where the leucine has been changed to a serine as described in Example 47. This binding region is connected to a mutated human IgG1 connecting region where all of the cysteines and one proline have been changed to serines (SSS-S) according to methods described in Example 5. This connecting region is connected to a wild type human IgG1 CH2 and CH3 constant region as described in Example 1. The polynucleotide sequence is provided in SEQ ID NO:365, and the encoded polypeptide sequence is provided in SEQ ID NO:366.

Example 78

2H7 scFv (SSS-S) H WCH2 WCH3

This construct has a 2H7 (anti-CD20) single chain Fv binding region as described in Example 1. This binding region is connected to a mutated human IgG1 connecting region where all of the cysteines and one proline have been changed to serines (SSS-S) according to methods described in Example 5. This connecting region is connected to a wild type IgG1 CH2 and CH3 constant region as described in Example 1. This construct has previously been referred to as 2H7-MHWTG1C, CytoxB-(MHWTG1C)—Ig, anti-CD20 scFv IgG MTH (SSS) WTCH2CH3, CytoxB-MHWTG1C, 2H7 scFv-human IgG1 wild type hinge-CH2-CH3, and 2H7 scFv IgG MTH (SSS) WTCH2CH3, which all have the same sequence as the above construct. The polynucleotide sequence is provided in SEQ ID NO:57, and the encoded polypeptide sequence is provided in SEQ ID NO:58.

Example 79

2H7 scFv (SSS-S) H P238SCH2 WCH3

This construct has a 2H7 (anti-CD20) single chain Fv binding region as described in Example 1. This binding region is connected to a mutated human IgG1 connecting region where all of the cysteines and one proline have been changed to serines (SSS-S) according to methods described in Example 5. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. This construct has previously been referred to as 2H7 scFv IgG MTH (SSS) MTCH2WTCH3, anti-CD20 scFv IgG MTH (SSS) MTCH2CH3, and CytoxB-MHMG1C which all have the same sequence as the above construct. The polynucleotide sequence is provided in SEQ ID NO:419, and the encoded polypeptide sequence is provided in SEQ ID NO:420.

Example 80

2H7 scFv IgAH WCH2 WCH3

This construct has a 2H7 (anti-CD20) single chain Fv binding region as described in Example 1. This binding region is connected to a human IgA connecting region and wild type human IgG1 CH2 and CH3 constant regions as described in Example 5. This construct has previously been referred to as 2H7 scFv IgAH IgG WTCH2CH3, 2H7 scFv IgA hinge-IgG1 CH2-CH3, and CytoxB-IgAHWTHG1C, which all have the same sequence as the above construct. The polynucleotide sequence is provided in SEQ ID NO:59, and the encoded polypeptide sequence is provided in SEQ ID NO:60.

Example 81

2H7 scFv IgAH WIgACH2 T4CH3

This construct has a 2H7 (anti-CD20) single chain Fv binding region as described in Example 1. This binding region is attached to a connecting region from human IgA as described in Example 5. This connecting region is attached to a human IgA constant region consisting of a wild type CH2 region and a mutated CH3 region where there is a truncation of 4 amino acid residues prior to the 3' stop codon as described in Example 13. This construct has previously been referred to as 2H7 scFv IgAH IgAT4, which has the same sequence as the above construct. The polynucleotide sequence is provided in SEQ ID NO:70, and the encoded polypeptide sequence is provided in SEQ ID NO:71.

Example 82

2H7 scFv IgAH WIgACH2 WCH3+Jchain

This construct has a 2H7 (anti-CD20) single chain Fv binding region as described in Example 1. This binding region is attached to a wild type human IgA connecting region as described in Example 5. This connecting region is attached to a wild type human IgA CH2 and CH3 constant region according to methods described in Example 13. This constant region is attached to a J-chain region as described in Example 13. The polynucleotide sequence is provided in SEQ ID NO:61, and the encoded polypeptide sequence is provided in SEQ ID NO:62.

Example 83

2H7 scFv (CCC-P) WH WCH2 WCH3

This construct has a 2H7 (anti-CD20) single chain Fv binding region as described in Example 1. This binding region is attached to a wild type human IgG1 connecting region (CCC-P) as described in Example 1. This connecting region is attached to wild type human IgG1 CH2 and CH3 constant regions as described in Example 1. This construct has previously been referred to as 2H7 scFv Ig WTH (CCC) WTCH2CH3, 2H7 scFv IgG WTH WTCH2CH3, and 2H7 scFv-Ig, which both have the same sequence as the above construct. The polynucleotide sequence is provided in SEQ ID NO:688, and the encoded polypeptide sequence is provided in SEQ ID NO:689.

Example 84

2H7 scFv (SSS-S) H WCH2 F405YCH3

This construct has a 2H7 (anti-CD20) single chain Fv binding region as described in Example 1. This binding region is connected to a mutated human IgG1 connecting region where all of the cysteines and one proline have been changed to serines (SSS-S) according to methods described in Example 5. This connecting region is attached to a wild type human IgG1 CH2 and a mutated human IgG1 CH3 region. The F405Y mutation, where the phenylalanine at residue 405 has been changed to a tyrosine, was introduced according to methods described in Example 21. This construct has previously been referred to as 2H7 scFv MTH WTCH2 MTCH3 Y405, which has the same sequence as the above construct. The polynucleotide sequence is provided in SEQ ID NO:153, and the encoded polypeptide sequence is provided in SEQ ID NO:154.

Example 85

2H7 scFv (SSS-S) H WCH2 F405ACH3

This construct has a 2H7 (anti-CD20) single chain Fv binding region as described in Example 1. This binding region is connected to a mutated human IgG1 connecting region where all of the cysteines and one proline have been changed to serines (SSS-S) according to methods described in Example 5. This connecting region is attached to a wild type human IgG1 CH2 and a mutated human IgG1 CH3 region. The F405A mutation, where the phenylalanine at residue 405 has been changed to an alanine, was introduced according to methods described in Example 21. This construct has previously been referred to as 2H7 scFv MTH WTCH2 MTCH3 A405, which has the same sequence as the above construct. The polynucleotide sequence is provided in SEQ ID NO:155, and the encoded polypeptide sequence is provided in SEQ ID NO:156.

Example 86

2H7 scFv (SSS-S) H WCH2 Y407ACH3

This construct has a 2H7 (anti-CD20) single chain Fv binding region as described in Example 1. This binding region is connected to a mutated human IgG1 connecting region where all of the cysteines and one proline have been changed to serines (SSS-S) according to methods described in Example 5. This connecting region is attached to a wild type human IgG1 CH2 and a mutated human IgG1 CH3 region. The Y407A mutation, where the tyrosine at residue 407 has been changed to an alanine, was introduced according to methods described in Example 21. This construct has previously been referred to as scFv MTH WTCH2 MTCH3 A407, which has the same sequence as the above construct. The polynucleotide sequence is provided in SEQ ID NO:157, and the encoded polypeptide sequence is provided in SEQ ID NO:158.

Example 87

2H7 scFv (SSS-S) HWCH2 F405A, Y407ACH3

This construct has a 2H7 (anti-CD20) single chain Fv binding region as described in Example 1. This binding region is connected to a mutated human IgG1 connecting region where all of the cysteines and one proline have been changed to serines (SSS-S), according to methods described in Example 5. This connecting region is attached to a wild type human IgG1 CH2 and a mutated human IgG1 CH3 region. The F405A and Y407A mutation, where the phenylalanine at residue 405 has been changed to an alanine and the tyrosine at residue 407 has been changed to an alanine, was introduced according to methods described in Example 21. This construct has previously been referred to as scFv MTH WTCH2 MTCH3 A405A407, which has the same sequence as the above construct. The polynucleotide sequence is provided in SEQ ID NO:161, and the encoded polypeptide sequence is provided in SEQ ID NO:162.

Example 88

2H7 scFv (CSS-S) H WCH2 WCH3

This construct has a 2H7 (anti-CD20) single chain Fv binding region as described in Example 1. This binding region is attached to a mutant human IgG1 connecting region, where the second and third cysteines have been changed to serines and the proline has been changed to serine (CSS-S), according to methods described in Example 13. This connecting region is attached to wild type human IgG1 CH2 and CH3 constant regions as described in Example 1. This construct has previously been referred to as 2H7 scFv MTH (CSS) WTCH2CH3, which has the same sequence as the above construct. The polynucleotide sequence is provided in SEQ ID NO:134, and the encoded polypeptide sequence is provided in SEQ ID NO:135.

Example 89

2H7 scFv (SCS-S) H WCH2 WCH3

This construct has a 2H7 (anti-CD20) single chain Fv binding region as described in Example 1. This binding region is attached to a mutant human IgG1 connecting region, where the first and third cysteines have been changed to serines and the proline has been changed to serine (SCS-S), according to methods described in Example 13. This connecting region is attached to wild type human IgG1 CH2 and CH3 constant regions as described in Example 1. This construct has previously been referred to as 2H7 scFv IgG MTH (SCS) WTCH2CH3, which has the same sequence as the above construct. The polynucleotide sequence is provided in SEQ ID NO:136, and the encoded polypeptide sequence is provided in SEQ ID NO:137.

Example 90

2H7 scFv (SSC-P) H WCH2 WCH3

This construct has a 2H7 (anti-CD20) single chain Fv binding region as described in Example 1. This binding region is attached to a mutant human IgG1 connecting region, where the first and second cysteines have been changed to serines (SSC-P), according to methods described in Example 13. This connecting region is attached to wild type human IgG1 CH2 and CH3 constant regions as described in Example 1. This construct has previously been referred to as 2H7 scFv MTH (SSC) WTCH2CH3, which has the same sequence as the above construct. The polynucleotide sequence is provided in SEQ ID NO:138, and the encoded polypeptide sequence is provided in SEQ ID NO:139.

Example 91

2H7 scFv (CSC-S) H WCH2 WCH3

This construct has a 2H7 (anti-CD20) single chain Fv binding region as described in Example 1. This binding region is attached to a mutant human IgG1 connecting region, where the second cysteine and the proline has been changed to serine (CSC-S), according to methods described in Example 32. This connecting region is attached to wild type human IgG1 CH2 and CH3 constant regions as described in Example 1. This construct has previously been referred to as 2H7 scFv MTH (CSC) WTCH2CH3, which has the same sequence as the above construct. The polynucleotide sequence is provided in SEQ ID NO:165, and the encoded polypeptide sequence is provided in SEQ ID NO:166.

Example 92

2H7 scFv (CCS-P) H WCH2 WCH3

This construct has a 2H7 (anti-CD20) single chain Fv binding region as described in Example 1. This binding region is attached to a mutant human IgG1 connecting region, where third cysteine has been changed to a serine (CCS-P), according to methods described in Example 22. This connecting region is attached to wild type human IgG1 CH2 and CH3 constant regions as described in Example 1. This construct has previously been referred to as 2H7 scFv MTH (CCS) WTCH2CH3, which has the same sequence as the above construct. The polynucleotide sequence is provided in SEQ ID NO:167, and the encoded polypeptide sequence is provided in SEQ ID NO:168.

Example 93

2H7 scFv (SCC-P) H WCH2 WCH3

This construct has a 2H7 (anti-CD20) single chain Fv binding region as described in Example 1. This binding region is attached to a mutant human IgG1 connecting region, where first cysteine has been changed to a serine (SCC-P), according to methods described in Example 32. This connecting region is attached to wild type human IgG1 CH2 and CH3 constant regions as described in Example 1. This construct has previously been referred to as 2H7 scFv MTH (SCC)

WTCH2CH3, which has the same sequence as the above construct. The polynucleotide sequence is provided in SEQ ID NO:163, and the encoded polypeptide sequence is provided in SEQ ID NO:164.

Example 94

2H7 scFv VH L11S (SSS-S) H WCH2 WCH3

This construct has a 2H7 (anti-CD20) single chain Fv binding region with a point mutation at amino acid residue 11 in the heavy chain variable region, where the leucine has been changed to a serine as described in Example 33. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. This construct has previously been referred to as 2H7 scFv VH11SER IgG MTH (SSS) WTCH2CH3 and 2H7 scFv VHSER11 WTH WTCH2CH3, which both have the same sequence as the above construct. The polynucleotide sequence is provided in SEQ ID NO:369, and the encoded polypeptide sequence is provided in SEQ ID NO:370.

Example 95

2H7 scFv VH L11S (CSS-S) H WCH2 WCH3

This construct has a 2H7 (anti-CD20) single chain Fv binding region with a point mutation at amino acid residue 11 in the heavy chain variable region, where the leucine has been changed to a serine as described in Example 33. This binding region is attached to a mutant human IgG1 connecting region, where the second and third cysteines have been changed to serines and the proline has been changed to serine (CSS-S), according to methods described in Example 13. This connecting region is attached to wild type human IgG1 CH2 and CH3 constant regions as described in Example 1. The polynucleotide sequence is provided in SEQ ID NO:371, and the encoded polypeptide sequence is provided in SEQ ID NO:372.

Example 96

G28-1 scFv VH L11S (SCS-S) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where the first and third cysteines have been changed to serines and the proline has been changed to serine (SCS-S), according to methods described in Example 13. This connecting region is attached to wild type human IgG1 CH2 and CH3 constant regions as described in Example 1. The polynucleotide sequence is provided in SEQ ID NO:373, and the encoded polypeptide sequence is provided in SEQ ID NO:374.

Example 97

G28-1 scFv V11 L11S(CCS-P) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where third cysteine has been changed to a serine (CCS-P), according to methods described in Example 22. This connecting region is attached to wild type human IgG1 CH2 and CH3 constant regions as described in Example 1. The polynucleotide sequence is provided in SEQ ID NO:375, and the encoded polypeptide sequence is provided in SEQ ID NO:376.

Example 98

G28-1 scFv VH L11S (SCC-P) H WCH2 WCH3

This construct has a G28-1 (anti-CD37) single chain Fv binding region with a point mutation at amino acid residue 11 in the heavy chain variable region, where the leucine has been changed to a serine as described in Example 35. This binding region is attached to a mutant human IgG1 connecting region, where first cysteine has been changed to a serine (SCC-P), according to methods described in Example 32. This connecting region is attached to wild type human IgG1 CH2 and CH3 constant regions as described in Example 1. The polynucleotide sequence is provided in SEQ ID NO:377, and the encoded polypeptide sequence is provided in SEQ ID NO:378.

Example 99

G28-1 scFv VH L11S mIgE CH2 CH3 CH4

This construct has a G28-1 (anti-CD37) single chain Fv binding region with a point mutation at amino acid residue 11 in the heavy chain variable region, where the leucine has been changed to a serine as described in Example 35. This binding region is attached to a wilt type mouse IgE CH2 CH3 and CH4 region using methods described in Example 39. The polynucleotide sequence is provided in SEQ ID NO:379, and the encoded polypeptide sequence is provided in SEQ ID NO:380.

Example 100

G28-1 scFv V11 L11S mIgAH WIgACH2 T4CH3

This construct has a G28-1 (anti-CD37) single chain Fv binding region with a point mutation at amino acid residue 11 in the heavy chain variable region, where the leucine has been changed to a serine as described in Example 35. This binding region is attached to a connecting region from mouse IgA as described in Example 39. This connecting region is attached to a mouse IgA constant region consisting of a wild type CH2 region and a mutated CH3 region where there is a 4 amino acid truncation at residues as described in Example 39. The polynucleotide sequence is provided in SEQ ID NO:381, and the encoded polypeptide sequence is provided in SEQ ID NO:382.

Example 101

G28-1 scFv VH L11S hIgE CH2 CH3 CH4

This construct has a G28-1 (anti-CD37) single chain Fv binding region with a point mutation at amino acid residue 11 in the heavy chain variable region, where the leucine has been changed to a serine as described in Example 35. This binding region is attached to a wild type human IgE constant region containing CH2, CH3 and CH4 as described in Example 38. The polynucleotide sequence is provided in SEQ ID NO:383, and the encoded polypeptide sequence is provided in SEQ ID NO:384.

Example 102

G28-1 scFv VH L118 hIgAH WIgACH2 T4CH3

This construct has a G28-1 (anti-CD37) single chain Fv binding region with a point mutation at amino acid residue 11 in the heavy chain variable region, where the leucine has been changed to a serine as described in Example 35. This binding region is attached to a connecting region from human IgA as described in Example 5. This connecting region is attached to a human IgA constant region consisting of a wild type CH2 region and a mutated CH3 region where there is a truncation of 4 amino acid residues prior to the 3' stop codon as described in Example 13. The polynucleotide sequence is provided in SEQ ID NO:385, and the encoded polypeptide sequence is provided in SEQ ID NO:386.

Example 103

HD37 scFv IgAH WCH2 WCH3

The HD37 scFv was cloned from the HD37 hybridoma using the Novagen -Ig family primer sets, TOPO cloning and sequencing and sewing PCR assay. For the initial PCR reactions prior to sewing, the TOPO clone templates HD37 VH C-1 and HD37 KVL B-9 were used at 1:100 with an amplification profile of 94 C 30 sec; 55 C, 30 sec; 72 C, 30 seconds for 25 cycles. To provide templates for the secondary SEWING PCR reactions, primary reaction products were gel purified, QIAQUICK purified, and the eluates diluted 50 fold. One microliter each VL and VH overlapping templates were added to PCR reactions with the following amplification profile: 94 C, 60 sec; 55 C, 60 sec; 72 C, 60 sec; for 30 cycles. After two cycles, the machine was paused, and the flanking 5'VL and 3'VH primers were added to the reactions at 25 pmol each, and the PCR reactions resumed. PCR products were checked on a gel for the presence of an 750-800 by fragment, and the reactions products QIAQUICK purified and digested with the appropriate restriction enzymes for insertion into pD18 Ig expression vectors.

PCR of VL domain with native leader peptide and part of glyser linker:

```
5' primer:
5'-gttgttaagcttgccgccatggagacagacacactc    (SEQ ID NO:
                                             650)
ctgctatgg-3'

3' primer:
5'gccacccgacccaccaccgcccgagccaccgccacct    (SEQ ID NO:
                                             651)
ttgatttccagcttggtgcctcc-3'
```

PCR of VL domain without leader peptide (SalI site) and part of glyser linker:

```
5' primer:
5'-gttgttgtcgacattgtgctgacccaatctcca-3'    (SEQ ID NO:
                                             652)
```

```
3' primer:
5'-gccacccgacccaccaccgcccgagccaccgccacc    (SEQ ID NO:
                                             651)
tttgatttccagcttggtgcctcc-3'
```

PCR of VH domain with part of glyser linker and BclI site for fusion to -Ig tails.

```
5' primer:
5'-tcgggcggtgggggtcgggtggcggcggatcgtca    (SEQ ID NO:
                                             653)
caggttcagctgcagcagtctgg-3'

3' primer:
5'-tcagtgctgatcagaggagacggtgactgaggttc    (SEQ ID NO:
                                             654)
cttg-3'
```

This binding region is connected to a wild type human IgA connecting region and wild type human IgG CH2 and CH3 constant regions as described in Example 5. This connecting region is attached to wild type human IgG1 CH2 and CH3 constant regions as described in Example 1. This construct has previously been referred to as HD37 scFv-IgAHWTG1C and HD37-IgAHWTG1C, which both have the same sequence as the above construct. The polynucleotide sequence is provided in SEQ ID NO:397, and the encoded polypeptide sequence is provided in SEQ ID NO:398.

Example 104

HD37 scFv (SSS-S) H WCH2 WCH3

This construct has a HD 37 single chain Fv as described in Example 103. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. This construct has previously been referred to as HD37-MHWTG1C and HD37 scFv-IgMHWTG1C, which both have the same sequence as the above construct. The polynucleotide sequence is provided in SEQ ID NO:399, and the encoded polypeptide sequence is provided in SEQ ID NO:400.

Example 105

HD37 scFv VH L11S (SSS-S) H WCH2 WCH3

This construct has a HD 37 single chain Fv with a mutation in the heavy chain variable region at amino acid residue 11, where leucine has been changed to serine according to the methods described in Example 50. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1.

The polynucleotide sequence is provided in SEQ ID NO:401, and the encoded polypeptide sequence is provided in SEQ ID NO:402.

Example 106

L6 scFv IgAH WCH2 WCH3

The L6 scFv was cloned from the L6 hybridoma (1Hellstrom) using the anchor-tailing method described in the Tissue Antigens Paper from 1996. The PCR profile was 94 C, 1 min; 50 C, 2 min; 72 C, 2 min; for 35 cycles. Once consensus sequence was obtained for VL and VH regions from at least 4 TOPO clones, primers were ordered for PCR reactions prior to SEWING PCR reactions as follows: For the initial PCR reactions prior to sewing, the TOPO cloned templates L6VK and L6VH were used at 1:100 with an amplification profile of 94 C 30 sec; 55 C, 30 sec; 72 C, 30 seconds for 25 cycles. To provide templates for the secondary SEWING PCR reactions, primary reaction products were gel purified, QIAQUICK purified, and the eluates diluted 50 fold. One microliter each VL and VH overlapping templates were added to PCR reactions with the following amplification profile: 94 C, 60 sec; 55 C, 60 sec; 72 C, 60 sec; for 30 cycles. After two cycles, the machine was paused, and the flanking 5'VL and 3'VH primers were added to the reactions at 25 pmol each, and the PCR reactions resumed. PCR products were checked on a gel for the presence of an 750-800 by fragment, and the reactions products QIAQUICK purified and digested with the appropriate restriction enzymes for insertion into pD18 Ig expression vectors.

PCR of VL domain with native leader peptide and part of glyser linker:

```
L6VLHindIII:
5'-gttgttaagcttgccgccatggattttcaagtgcag    (SEQ ID NO:
                                              655)
attttcagcttc-3'

L6VLLK3:
5'-gccacccgacccaccaccgcccgagccaccgccacc    (SEQ ID NO:
                                              656)
agagagctcmcagctccagcug-3'
```

PCR of VL domain without leader peptide (SalI site) and part of glyser linker:

```
5' primer:
5'-gttgttgtcgacattgttctctcccagtctccagca    (SEQ ID NO:
                                              657)
atcctgtctg-3'

3' primer:
5'-gccacccgacccaccaccgcccgagccaccgccacc    (SEQ ID NO:
                                              656)
agagagctctttcagctccagcttggt-3'
```

PCR of VH domain with part of glyser linker and BclI site for fusion to -Ig tails.

```
5':
5'-tcgggcggtggtgggtcgggtggcggcggatctctg    (SEQ ID NO:
                                              658)
cagatccagttggtgcagtct-3'
```

```
-continued
3'Bcl:
5'-tcagtgctgatcagaggagactgtgagagtggtgcc    (SEQ ID NO:
                                              659)
ttg-3'
```

This binding region is connected to a human IgA connecting region and wild type human IgG1 CH2 and CH3 constant regions as described in Example 5. This connecting region is attached to wild type human IgG1 CH2 and CH3 constant regions as described in Example 1. This construct has previously been referred to as L6 scFv-IgAHWTG1C, which HAS the same sequence as the above construct. The polynucleotide sequence is provided in SEQ ID NO:413, and the encoded polypeptide sequence is provided in SEQ ID NO:414.

Example 107

L6 scFv VHL11S (SSS-S) H WCH2 WCH3

This construct has a L6 single chain Fv with a mutation in the heavy chain variable region at amino acid residue 11, where leucine has been changed to serine according to the methods described in Example 49. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The polynucleotide sequence is provided in SEQ ID NO:415, and the encoded polypeptide sequence is provided in SEQ ID NO:416.

Example 108

2H7 scFv-Llama IgG1

This construct has a 2H7 (anti-CD20) single chain Fv binding region as described in Example 1. This binding region is attached to a llama IgG1 hinge, CH2 and CH3 regions according to the methods described in Example 10. The polynucleotide sequence is provided in SEQ ID NO:21, and the encoded polypeptide sequence is provided in SEQ ID NO:22.

Example 109

2H7 scFv-Llama IgG2

This construct has a 2H7 (anti-CD20) single chain Fv binding region as described in Example 1. This binding region is attached to a llama IgG2 hinge, CH2 and CH3 regions according to the methods described in Example 10. The polynucleotide sequence is provided in SEQ ID NO:23, and the encoded polypeptide sequence is provided in SEQ ID NO:24.

Example 110

2H7 scFv-Llama IgG3

This construct has a 2H7 (anti-CD20) single chain Fv binding region as described in Example 1. This binding region is attached to a llama IgG3 hinge, CH2 and CH3 regions according to the methods described in Example 10. The polynucleotide sequence is provided in SEQ ID NO:25, and the encoded polypeptide sequence is provided in SEQ ID NO:26.

Example 111

CD16 Low (ED)(SSS-S) H P238SCH2 WCH3

This construct has the extra cellular, CD16 low affinity allele binding domain as described in Example 43. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The polynucleotide sequence is provided in SEQ ID NO:421, and the encoded polypeptide sequence is provided in SEQ ID NO:422.

Example 112

CD16-9 High (ED)(SSS-S) H P238SCH2 WCH3

This construct has the extra cellular, CD16 high affinity allele binding domain as described in Example 43. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The polynucleotide sequence is provided in SEQ ID NO:425, and the encoded polypeptide sequence is provided in SEQ ID NO:426.

Example 113

2e12 scFv (SSS-S)H P238SCH2 WCH3-hCD80TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to a mutated human IgG1 CH2 region and a wild type human IgG1 CH3 region. The P238S mutation, where a proline at residue 238 was changed to a serine, was introduced according to methods described in Example 70. The CH3 region is attached to a human CD80 transmembrane and cytoplasmic tail region (hCD80 TM/CT). The hCD80 TM/CT was cloned using random primed cDNA derived from the BJAB cell line according to methods described in Example 12. This TM/CT region was attached to a Ig CH3 region with an open reading frame (ORF). Open reading frame versions of scFvIg constructs of interest were created by replacement of the soluble versions of each -Ig tail with ORF (open reading frame versions) of these tails. PCR primers were designed for the existing clones of soluble -Ig tails which delete the stop codon and add one or more restriction sites to the 3' end of the new -Ig cassettes. The desired transmembrane and cytoplasmic tail sequences can then be subcloned downstream of these new -Ig cassettes. Each construct utilized the existing available 5' BCLI oligonucleotide used in amplifying the soluble version of the tails for the PCR reactions. The 3' oligonucleotides replace the stop codon with out of frame restriction sites fused to the coding region for protein domains involved in regulation of apoptosis.

The PCR amplifications were carried out with 25 pmol of each primer, standard PCR reagents, and varying volumes of either cloned domains or cDNA obtained from PBMC, spleen, or thymus RNA. The reactions used a cycling profile of 94 C, 60sec; 55 C, 60 sec; 72 C, 2 min, for 35 cycles. The primers for the IgG ORF are listed below.

```
5' primer:
5'-gttgtagatcaggagcccaaatcttctgacaaaac   (SEQ ID NO:
                                          660)

tcacacatctccaccgtccccagcacctgaactcctggg ggaccgtcagtcttcc-3'

3' primer:
5'-gttgttttcgaaggatccgctttacccgggagcag   (SEQ ID NO:
                                          661)

ggagaggctcttctgcgtgtagtg-3'
```

The polynucleotide sequence is provided in SEQ ID NO:437, and the encoded polypeptide sequence is provided in SEQ ID NO:438.

Example 114

10A8 scFv (SSS-S)H P238SCH2 WCH3-hCD80TM/CT

This construct has a 10A8 (anti-CD2152) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. This CH3 region is attached to a hCD80 TM/CT according to methods described in Example 113. The polynucleotide sequence is provided in SEQ ID NO:439, and the encoded polypeptide sequence is provided in SEQ ID NO:440.

Example 115

40.2.220 scFv (SSS-S)H P238SCH2 WCH3-hCD80TM/CT

This construct has a 40.2.220 (anti-CD40) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. This CH3 region is attached to a hCD80 TM/CT according to methods described in Example 113.

Example 116

2H7 scFv (SSS-S)H P238SCH2 WCH3-hCD80TM/CT

This construct has a 2H7 (anti-CD20) single chain Fv binding region as described in Example 1. This binding region is connected to a mutated human IgG1 connecting region where all of the cysteines and one proline have been changed to serines (SSS-S), according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. This CH3 region is attached to a hCD80 TM/CT according to methods described in Example 113. This construct has previously been referred to as: The polynucleotide sequence is provided in SEQ ID NO:441, and the encoded polypeptide sequence is provided in SEQ ID NO:442.

Example 117

G19-4 scFv (SSS-S)H P238SCH2 WCH3-hCD80TM/CT

This construct has a G19 (anti-CD3) single chain Fv binding region described in Example 29. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. This CH3 region is attached to a hCD80 TM/CT according to methods described in Example 113. The polynucleotide sequence is provided in SEQ ID NO:443, and the encoded polypeptide sequence is provided in SEQ ID NO:444.

Example 118

2E12 scFv (SSS-S)H WCH2 WCH3-hCD80TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. This CH3 region is attached to a hCD80 TM/CT according to methods described in Example 113. This construct has previously been referred to as 2e12 scFv IgG WTH WHTCH3CH2-CD80, which has the same sequence as the above construct. The polynucleotide sequence is provided in SEQ ID NO:126, and the encoded polypeptide sequence is provided in SEQ ID NO:127.

Example 119

2E12 scFv IgAH IgACH2 T4CH3-hCD80TM/CT

This construct has a 2e12 (anti-CD28) single chain Fv binding region described in Example 12. This binding region is attached to a connecting region from human IgA as described in Example 5. This connecting region is attached to a human IgA constant region consisting of a wild type CH2 region and a mutated CH3 region where there is a truncation of 4 amino acid residues prior to the 3' stop codon as described in Example 13. This CH3 region is attached to a hCD80 TM/CT according to methods described in Example 113. The specific primers used to create an IgA ORF are listed below.

```
5'primer:
5'-gttgttgatcagccagttccctcaactccacctac  (SEQ ID NO:
                                         662)

c-3'

3'primer:
5'-gttgttttcgaaggatccgcgtccacctccgccatg (SEQ ID NO:
                                         663)

acaacaga
```

The polynucleotide sequence is provided in SEQ ID NO:445, and the encoded polypeptide sequence is provided in SEQ ID NO:446.

Example 120

2E12 scFv IgE CH2CH3CH4-hCD80TM/CT

This construct has a 2e12 (anti-CD28) single chain Fv binding region described in Example 12. This binding region is attached to a human IgE constant region containing CH2, CH3 and CH4 as described in Example 38. This CH4 region is attached to a hCD80 TM/CT essentially according to methods described in Example 113. The specific primers used to create an IgE ORF are listed below.

```
5' primer:
5'-gttgttgatcacgtctgctccagggacttcacc-3' (SEQ ID NO:
                                         664)

3' primer:
5'-gttgttttcgaaggatccgctttaccagatttacag (SEQ ID NO:
                                         665)
acaccgctcgctg-3'
```

The polynucleotide sequence is provided in SEQ ID NO:183, and the encoded polypeptide sequence is provided in SEQ ID NO:184.

Example 121

2E12 scFv (SSS-S)H P238SCH2 WCH3-mFADD-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a mouse FADD transmembrane ans cytoplasmic tail region (mFADD TM/CT). This region is cloned using essentially the same methods described in Example 113. The domain was PCR amplified from randomly primed cDNA from mouse spleen RNA. The specific primers are listed below.

5' primer:
5'-gttgtggatccttcgaacccattcctggtgctgctg (SEQ ID NO: 666)
cactcgctg-3'

3' primer:
5'-gttgttatcgatctcgagtcagggtgtttctgagga (SEQ ID NO: 667)
agacacagt-3'

The specific primers used to create a mouse IgG ORF are listed below.

5'primer:
5'-gttgtagatctggagcccagagggcccacaatcaag (SEQ ID NO: 668)
ccctctcctccaagcaaaagccca-3'

3'primer:
5'-gttgttttcgaaggatccgctttacccggagtccgg (SEQ ID NO: 669)
gagaag-3'

The polynucleotide sequence is provided in SEQ ID NO:447, and the encoded polypeptide sequence is provided in SEQ ID NO:448.

Example 122

2E12 scFv (SSS-S)H WCH2 WCH3-mFADD-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region was attached to a mFADD TM/TM region according to methods described in Example 113 and 121. The polynucleotide sequence is provided in SEQ ID NO:449, and the encoded polypeptide sequence is provided in SEQ ID NO:450.

Example 123

2E12 scFv (SSS-S)H WCH2 WCH3-mcasp3-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a mouse casp3 transmembrane and ctyoplasmic tail region according to methods described in Examples 113 and 121. The specific primers used to isolate the mcasp3 TM/CT region are listed below:

5' primer:
5'-gttgttggatccttcgaacatggagaacaacaaaac (SEQ ID NO: 670)
ctcagtggattca-3'

3' primer:
5'-gttgttatcgatctcgagctagtgataaaagtacag (SEQ ID NO: 671)
ttctttcgt-3'

The polynucleotide sequence is provided in SEQ ID NO:453, and the encoded polypeptide sequence is provided in SEQ ID NO:454.

Example 124

2E12 scFv (SSS-S)H P238SCH2 WCH3-mcasp3-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is connected to a mcasp3 TM/CT region according to methods described in Examples 113, 121 and 123. The polynucleotide sequence is provided in SEQ ID NO:455, and the encoded polypeptide sequence is provided in SEQ ID NO:456.

Example 125

2E12 scFv (SSS-S)H WCH2 WCH3-mcasp8-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a mouse casp8 transmemebrane and cytoplasmic tail region (mcasp8 TM/CT) essentially according to methods described in Example 113 and 121. The specific primers used to clone the mcasp8 TM/CT region are listed below.

5' primer:
5'-gttgtttcgaacatggatttccagagttgtctttat (SEQ ID NO: 672)
gctattgctg-3'

3' primer:
5'-gttgttatcgatctcgagtcattagggagggaagaa (SEQ ID NO: 673)
gagcttcttcg-3'

The polynucleotide sequence is provided in SEQ ID NO:459, and the encoded polypeptide sequence is provided in SEQ ID NO:460.

Example 126

2E12 scFv (SSS-S)H P238SCH2 WCH3-mcasp8-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region was attached to a mcasp8 TM/CT region according to methods described in Examples 113, 121 and 125. The polynucleotide sequence is provided in SEQ ID NO:461, and the encoded polypeptide sequence is provided in SEQ ID NO:462.

Example 127

2E12 scFv (SSS-S)H WCH2 WCH3-Hcasp3-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region was attached to a human casp3 transmembrane and cytoplasmic tail region (hcasp3 TM/CT) essentially according to methods describe in Examples 113. The specific primers used to clone the hcasp3 TM/CT region are listed below.

```
5' Primer:
                                    (SEQ ID NO:
5'-gttgtggatccttcgaacatggagaacactgaaaac    674)
tcagtggat-3'

3' Primer:
                                    (SEQ ID NO:
5'-gttatcgatctcgagtagtgataaaaatagagttct    675)
tttgtgag-3'
```

The polynucleotide sequence is provided in SEQ ID NO:465, and the encoded polypeptide sequence is provided in SEQ ID NO:466.

Example 128

2E12 scFv (SSS-S)H P238SCH2 WCH3-hcasp3-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a hcasp3 TM/CT region according to methods described in Examples 113 and 127. The polynucleotide sequence is provided in SEQ ID NO:467, and the encoded polypeptide sequence is provided in SEQ ID NO:468.

Example 129

2E12 scFv (SSS-S)H WCH2 WCH3-hcasp8-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a human casp8 transmembrane and cytoplasmic tail region (hcasp8 TM/CT) according to methods described in Example 133. The specific primers used to clone the hcasp8 TM/CT region are listed below.

```
5' Primer:
                                    (SEQ ID NO: 676)
5'-gttgtggatccttcgaacatggacttcagcagaaatctttatg
at-3'

3' Primer:
                                    (SEQ ID NO: 677)
5'-gttgttatcgatgcatgctcaatcagaagggaagacaagtttttttt
ct-3'
```

The polynucleotide sequence is provided in SEQ ID NO:473, and the encoded polypeptide sequence is provided in SEQ ID NO:474.

Example 130

2E12 scFv (SSS-S)H P238SCH2 WCH3-hcasp8-TM/CT

This construct has a 2e12 (anti-CD28) single chain Fv binding region described in Example 12. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a hcasp8 TM/CT according to methods described in Examples 113 and 129. The polynucleotide sequence is provided in SEQ ID NO:475, and the encoded polypeptide sequence is provided in SEQ ID NO:476.

Example 131

1D8 scFv (SSS-S)H P238SCH2 WCH3-HCD80TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a hCD80 TM/CT region according to methods described in Example 113. The polynucleotide sequence is provided in SEQ ID NO:108, and the encoded polypeptide sequence is provided in SEQ ID NO:109.

Example 132

1D8 scFv (SSS-S)H WCH2 WCH3-hCD80TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a hCD80 TM/CT region according to methods described in Example 113. This construct has previously been referred to as 1D8 scFv IgG WTH WTCH2CH3-CD80, which has the same sequence as the above construct. The polynucleotide sequence is provided in SEQ ID NO:481, and the encoded polypeptide sequence is provided in SEQ ID NO:482.

Example 133

1D8 scFv-mIgAH WIgA CH2 T4CH3-hCD80TM/CT

This construct has a 1D8 (anti-4-1BB) single chain Fv binding region described in Example 25. This binding region is attached to a connecting region from human IgA as described in Example 5. This connecting region is attached to a mouse IgA constant region consisting of a wild type CH2 region and a mutated CH3 region where there is a truncation of 4 amino acid residues prior to the 3' stop codon as described in Example 39. The CH3 region can be attached to a hCD80 TM/CT region according to methods described in Examples 113 using primers that create an IgA ORF (SEQ ID NOs: 483 and 484).

Example 134

1D8 scFv IgE CH2CH3CH4-HCD80TM/CT

This construct has a 1D8 (anti-4-1BB) single chain Fv binding region described in Example 25. This binding region is attached to a human IgE constant region containing CH2, CH3 and CH4 as described in Example 38. The CH4 region is attached to a hCD80 TM/CT according to methods described in Examples 113 and 120. The polynucleotide sequence is provided in SEQ ID NO:175, and the encoded polypeptide sequence is provided in SEQ ID NO:176.

Example 135

1D8 scFv (SSS-S)H P238SCH2 WCH3-mFADD-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region was attached to a mFADD TM/TM region according to methods described in Example 113 and 121. The polynucleotide sequence is provided in SEQ ID NO:487, and the encoded polypeptide sequence is provided in SEQ ID NO:488.

Example 136

1D8 scFv (SSS-S)H WCH2 WCH3-mFADD-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region was attached to a mFADD TM/TM region according to methods described in Example 113 and 121. The polynucleotide sequence is provided in SEQ ID NO:485, and the encoded polypeptide sequence is provided in SEQ ID NO:486.

Example 137

1D8 scFv (SSS-S)H WCH2 WCH3-mcasp3-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region was attached to a mcasp3 TM/TM region according to methods described in Example 113, 121 and 123. The polynucleotide sequence is provided in SEQ ID NO:489, and the encoded polypeptide sequence is provided in SEQ ID NO:490.

Example 138

1D8 scFv (SSS-S)H P238SCH2 WCH3-mcasp3-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region was attached to a mcasp3 TM/TM region according to methods described in Example 113, 121 and 123. The polynucleotide sequence is

Example 139

1D8 scFv (SSS-S)H WCH2 WCH3-mcasp8-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region was attached to a mcasp8 TM/TM region according to methods described in Example 113, 121 and 125. The polynucleotide sequence is provided in SEQ ID NO:493, and the encoded polypeptide sequence is provided in SEQ ID NO:494.

Example 140

1D8 scFv (SSS-S)H P238SCH2 WCH3-mcasp8-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region was attached to a mcasp8 TM/TM region according to methods described in Example 113, 121 and 125. The polynucleotide sequence is provided in SEQ ID NO:495, and the encoded polypeptide sequence is provided in SEQ ID NO:496.

Example 141

1D8 scFv (SSS-S)H WCH2 WCH3-hcasp3-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a hcasp3 TM/CT according to methods described in Examples 113 and 127. The polynucleotide sequence is provided in SEQ ID NO:497, and the encoded polypeptide sequence is provided in SEQ ID NO:498.

Example 142

1D8 scFv (SSS-S)H P238SCH2 WCH3-hcasp3-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a hcasp3 TM/CT according to methods described in Examples 113 and 127. The polynucleotide sequence is provided in SEQ ID NO:499, and the encoded polypeptide sequence is provided in SEQ ID NO:500.

Example 143

1D8 scFv (SSS-S)H WCH2 WCH3-hcasp8-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. The CH3 region is attached to a hcasp8 TM/CT according to methods described in Examples 113 and 129. The polynucleotide sequence is provided in SEQ ID NO:501, and the encoded polypeptide sequence is provided in SEQ ID NO:502.

Example 144

1D8 scFv (SSS-s)H P238SCH2 WCH3-hcasp8-TM/CT

This construct has a 1D8 (anti-4-1BB) single chain Fv binding region described in Example 25. This binding region is connected to a mutated human IgG1 connecting region where all of the cysteines and one proline have been changed to serines (SSS-S) according to methods described in Example 5. This hinge region is attached to a mutated human IgG1 CH2 region and a wild type human IgG1 CH3 region. The P238S mutation, where a proline at residue 238 was changed to a serine, was introduced according to methods described in Example 70. The CH3 region is attached to a hcasp8 TM/CT according to methods described in Examples 113 and 129. The polynucleotide sequence is provided in SEQ ID NO:503, and the encoded polypeptide sequence is provided in SEQ ID NO:504.

Example 145

L6 scFv (SSS-S) H WCH2 WCH3

This construct has a L6 scFv binding domain as described in Example 105. This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. This construct has previously been referred to as L6 scFv-IgMHWTG1C, which has the same sequence as the above construct. The polynucleotide sequence is provided in SEQ ID NO:415, and the encoded polypeptide sequence is provided in SEQ ID NO:416.

Example 146

2H7 scFv CD154 (L2)

This construct has a 2H7 (anti-CD20) single chain Fv binding region as described in Example 1. This binding region has been attached to CD154 extracellular domain according to methods described in Example 4. The polynucleotide sequence is provided in SEQ ID NO:690, and the encoded polypeptide sequence is provided in SEQ ID NO:691.

Example 147

2H7 scFv CD154 (S4)

This construct has a 2H7 (anti-CD20) single chain Fv binding region as described in Example 1. This binding region has been attached to CD154 extracellular domain according to methods described in Example 4, such that methods of attachment resulted in a truncated version compared to the construct describe in Example 146. The polynucleotide sequence is provided in SEQ ID NO:692, and the encoded polypeptide sequence is provided in SEQ ID NO:693.

Example 148

CTLA4 IgAH IgACH2CH3

This construct has the extra cellular CTLA-4 binding region as described in Example 14. This binding region is attached to a wild type human IgA connecting region as described in Example 5. This connecting region is attached to a wild type human IgA CH2 and CH3 constant region according to methods described in Example 13. This constant region is attached to a J-chain region as described in Example 13. This construct has previously been referred to as CTLA-4 IgAH IgACH2CH3, which has the same sequence as the above construct. The polynucleotide sequence is provided in SEQ ID NO:505, and the encoded polypeptide sequence is provided in SEQ ID NO:506.

Example 149

CTLA4 IgAH IgACH2 T4-CH3

This construct has the extra cellular CTLA-4 binding region as described in Example 14. This binding region is attached to a connecting region from human IgA as described in Example 5. This connecting region is attached to a human IgA constant region consisting of a wild type CH2 region and a mutated CH3 region where there is a truncation of 4 amino acid residues prior to the 3' stop codon as described in Example 13. This construct has previously been referred to as CTLA-4 IgAH IgA-T4, which has the same sequence as the above construct. The polynucleotide sequence is provided in SEQ ID NO:507, and the encoded polypeptide sequence is provided in SEQ ID NO:508.

Example 150

2H7 scFv IgAH IgACH2CH3

This construct has a 2H7 (anti-CD20) single chain Fv binding region as described in Example 1. This binding region is attached to a wild type human IgA connecting region as described in Example 5. This connecting region is attached to a wild type human IgA CH2 and CH3 constant region according to methods described in Example 13. The polynucleotide sequence is provided in SEQ ID NO:61, and the encoded polypeptide sequence is provided in SEQ ID NO:62.

Example 151

2H7 scFv IgAH IgAHCH2 T18CH3

This construct has a 2H7 (anti-CD20) single chain Fv binding region as described in Example 1. This binding region is attached to a connecting region from human IgA as described in Example 5. This connecting region is attached to a human IgA constant region consisting of a wild type CH2 region and a mutated CH3 region where there is a truncation of 18 amino acid residues prior to the 3' stop codon as described in Example 13. The polynucleotide sequence is provided in SEQ ID NO:509, and the encoded polypeptide sequence is provided in SEQ ID NO:510.

Example 152

2H7-40.2.220 scFv (SSS-S) H WCH2 WCH3

A bispecific fusion protein was constructed between 2H7 scFv (anti-CD20) and 40.2.220 (anti-CD40), which both target B cell receptors. The 2H7 scFv hIgG1 (SSS-S)H WCH2 WCH3 construct in the expression vector pD18 was passaged through dam⁻ bacteria in order to permit cleavage at the BclI site. Cleaved plasmid was treated with alkaline phosphatase prior to ligation to a BclI cut linker-CD40 scFv fragment. This fragment was synthesized from the existing 40.2.220 scFv by successive PCR reactions with overlapping primers. The linker attached is a previously patented (BMS patent issued) helical type linker with a high number of lysine and glutamic acid residues. The scFv for CD40 was PCR amplified without the leader peptide as a SalI-BclI fragment, but with the hinge type linker substituted at the amino terminus as a BclI-SalI fragment, to mediate insertion of the linker-scFv cassette as a BclI fragment between the scFv and -Ig tail included in an existing scFvIg construct for CD20 (2H7 scFv hIgG1 constructs). The 3' end was similar to the other scFv VH molecules with an out of frame BclI site fused to the VTVSS type sequence at the end of the VH domain.

PCR oligos:

40.2.220 scFv:

5' primer--40.2.220S5:

(SEQ ID NO: 678)
5'-gttgttgtcgacattgttctgactcagtctccagccaccctgtc-3'

3' primer--40.2.220Bcl3:

(SEQ ID NO: 679)
5'-gttgttgatcagagacagtgaccagtgtcccttgg-3'

Linker Primers:

BclI-SalI fragment created by annealing complementary oligonucleotides. This fragment is then ligated into BclI digested vector along with a SalI-BclI scFv to create the (linker-scFv) BclI fragment desired for shuttling.

5' primer:
(SEQ ID NO: 560)
5'-gatcaatccaactctgaagaagcaaagaaagaggaggccaaaaagga
ggaagccaagaaatctaacagcg-3'

3' primer:
(SEQ ID NO: 563)
5'-tcgacgctgttagatttcttggcttcctccttttggcctcctcttt
ctttgcttcttcagagttggatt-3'

This BclI fragment was then ligated downstream of the 2H7 scFv in pD18-Ig. Transformants were screened for the presence of a 2.4 kb HindIII-Xba insert and positive clones sequenced prior to further studies. COS cell transient transfections were performed with this construct and culture supernatants screened for the presence of protein of the predicted size and for binding to CD20 and to CD40 transfected CHO cells.

New bispecific constructs can be created by designing hinge type linkers which incorporate one or preferably two restriction sites at either end of the linker, facilitating asymmetric digests and transfer of (linker-scFv) or (scFv-linker) cassettes between different constructs. These constructs will also incorporate the VH L11S and other V region substitutions, which presumably facilitate proper folding and result in increased expression of the molecules in which they are inserted.

This binding region is connected to a mutated human IgG1 connecting region where all of the cysteines and one proline have been changed to serines (SSS-S) according to methods described in Example 5. This connecting region is attached to wild type human IgG1 CH2 and CH3 constant regions as described in Example 1. This construct has previously been referred to as anti-CD20-anti-CD40 scFv IgG MTH (SSS) MTCH2WTCH3, which has the same sequence as the above construct. The polynucleotide sequence is provided in SEQ ID NO:114, and the encoded polypeptide sequence is provided in SEQ ID NO:115.

Example 153

2H7 scFv IgAH IgACH2 T4-CH3-hCD80 TM/CT

This construct has a 2H7 (anti-CD20) single chain Fv binding region as described in Example 1. This binding region is attached to a connecting region from human IgA as described in Example 5. This connecting region is attached to a human IgA constant region consisting of a wild type CH2 region and a mutated CH3 region where there is a truncation of 4 amino acid residues prior to the 3' stop codon as described in Example 13. This CH3 region is attached to a hCD80 TM/CT according to the methods described in Examples 113 and 119. This construct has previously been referred to as 2H7 scFv IgA hinge IgA-T4-CD80 and 2H7 scFv IgAH IgA-T4-CD80, which both have the same sequence as the above construct. The polynucleotide sequence is provided in SEQ ID NOs:70 and 29, and the encoded polypeptide sequence is provided in SEQ ID NOs:71 and 30.

Example 154

G19-4 scFv (CCC-P) WH WCH2 WCH3-hCD80 TM/CT

This construct has a G19 (anti-CD3) single chain Fv binding region described in Example 29. This binding region is attached to a wild type human IgG1 connecting region (CCC-P) as described in Example 1. This connecting region is attached to wild type human IgG1 CH2 and CH3 constant regions as described in Example 1. This CH3 region is attached to a hCD80 TM/CT according to the methods described in Examples 113. The polynucleotide sequence is provided in SEQ ID NOs:112 and 29, and the encoded polypeptide sequence is provided in SEQ ID NOs:113 and 30.

Example 155

2E12 scFv (CCC-P) WH WCH2 WCH3-HCD80 TM/CT

This construct has a 2e12 (anti-CD28) single chain Fv binding region described in Example 12. This binding region is attached to a wild type human IgG1 connecting region (CCC-P) as described in Example 1. This connecting region is attached to wild type human IgG1 CH2 and CH3 constant regions as described in Example 1. This CH3 region is attached to a hCD80 TM/CT according to the methods described in Examples 113. The polynucleotide sequence is provided in SEQ ID NO:126, and the encoded polypeptide sequence is provided in SEQ ID NO:127.

Example 156

2H7 VHL11S scFv (SSS-S) IgECH3CH4

This construct has a 2H7 (anti-CD20) single chain Fv binding region with a point mutation at amino acid residue 11 in the heavy chain variable region, where the leucine has been changed to a serine as described in Example 33. This binding region is connected to a mutated human IgG1 connecting region where all of the cysteines and one proline have been changed to serines (SSS-S) according to methods described in Example 5. This connecting region is attached to human IgE CH3 and CH4 constant region. This truncated constant region was created according to the methods described in Example 38. The polynucleotide sequence is provided in SEQ ID NO:227, and the encoded polypeptide sequence is provided in SEQ ID NO:228.

Example 157

IgD Hinge

An alternative hinge region can be isolated from human IgD immunoglobulin hinge region by using PCR assay to isolate the desired region. The PCR reaction is the same used in Example 1. This hinge was truncated by 6 amino acid residues at the 3' end. The primers used in this PCR reaction are listed below.

5" Primer:
(SEQ ID NO: 534)
5'-GTGGATCCAGGTTCGAAGTCTCGAAAGGCACAGGCC-3'

3' primer:
(SEQ ID NO: 517)
5'-GTTGTCGACTGCACGGGTCTTTGTCTCTCTCTCTTC-3'

The polynucleotide sequence is provided in SEQ ID NO:237, and the encoded polypeptide sequence is provided in SEQ ID NO:238.

Example 158 hCD28 TM/CT

For some of the cell surface ORF constructs, the transmembrane domain of CD80 was substituted with the transmembrane domain of human CD28 because it forms a dimer on the cell surface rather than a monomer as the CD80 does. Several of the molecules which drive the apoptotic program require oligomerization/trimerization to form a signaling complex; therefore, it is important to be able to control initiation of signaling by controlling the degree of oligomerization of these recombinant receptors on the cell surface.

The primers used in PCR amplification of the CD28 tail are given below:

```
5' Primer:
                                    (SEQ ID NO: 518)
5'-gttgtggatccttcgaaccccttttgggtgctggtggtggttggtg ga-3'

3' primer:
                                    (SEQ ID NO: 519)
5'-gttgttatcgatctcgagtcaggagcgataggctgcgaagtc-3'
```

Example 159

2H7 scFv VH L11S (SSS-S) H K322L CH2 WCH3

This construct has a 2H7 (anti-CD20) single chain Fv binding region with a point mutation at amino acid residue 11 in the heavy chain variable region, where the leucine has been changed to a serine. as described in Example 33. This binding region is connected to a mutated human IgG connecting region where all of the cysteines and one proline have been changed to serines (SSS-S) according to methods described in Example 5. The connecting region is attached to a mutated IgG CH2 region and a wild type IgG CH3 region. The K322L mutation in the CH2 region is at a residue 322, where a Lysine has been changed to a leucine using overlapping PCR described in Example 56, but with different primers for the first PCR reaction, which are listed below.

```
5' primer:
                                    (SEQ ID NO: 635)
5'ttcctcttccccccaaaacccaaggacaccctcatgatctcccgga accctgaggtcac-3'

3' primer:
                                    (SEQ ID NO: 621)
5'-ggacagtgggagtggcacc-3'
```

PCR product was cloned into TOPO vector and sequenced. The polynucleotide sequence is provided in SEQ ID NO:265, and the encoded polypeptide sequence is provided in SEQ ID NO:266.

Example 160

2H7 scFv VH L11S(CSS-S) H K322L CH2 WCH3

This construct has a 2H7 (anti-CD20) single chain Fv binding region with a point mutation at amino acid residue 11 in the heavy chain variable region, where the leucine has been changed to a serine, as described in Example 33. This binding region is attached to a mutant IgG connecting region, where the second and third cysteines have been changed to serines and the proline has been changed to serine (CSS-S), according to methods described in Example 13. The connecting region is attached to a mutated IgG CH2 region and a wild type IgG CH3 region. The K322L mutation in the CH2 region is at a residue 322, where a Lysine has been changed to a leucine using overlapping PCR described in Example 56, using primers from Example 159 in the first PCR reaction and primers from Example 57 for the second PCR reaction.

PCR products were cloned into the TOPO vector and sequenced. The polynucleotide sequence is provided in SEQ ID NO:261, and the encoded polypeptide sequence is provided in SEQ ID NO:262.

Example 161

In Vivo B Cell Depletion by 2H7 scFv (SSS-S) H WCH2 WCH3 and 2H7 scFv (SSS-S) H P238SCH2 WCH3

This Example describes experiments relating to ADCC effector mechanisms in the depletion of B cells through comparison of the activities of an anti-CD20 construct (2H7 scFv (SSS-S) H WCH2 WCH3) and a anti-CD20 construct with a proline to serine amino acid substitution in the CH2 domain (2H7 scFv (SSS-S) H P238SCH2 WCH3). FIG. 72 shows the results of an experiment on apoptosis induction by these constructs. The results indicated that both molecules bind CD20 and induce apoptosis that is mediated by activation of caspase 3.

FIG. 73 illustrates that anti-CD20 constructs mediate CDC activity towards CD20 positive target cells. A 2H7 scFv (SSS-S) H WCH2 WCH3 construct, a 2H7 scFv (SSS-S) H P238SCH2 WCH3 construct, or Rituximab were incubated at increasing concentrations with $10^4$ Bjab Target Cells and a 1:10 dilution of rabbit complement (PelFreez) in a volume of 100 microliters for sixty minutes. Aliquots were stained with trypan blue (Invitrogen), and counted using a hemacytometer to determine the percentage of the cell population killed during treatment. Negative controls with cells and only one reagent were also included. FIG. 74 illustrates that the 2H7 scFv (SSS-S) H WCH2 WCH3 construct was effective in ADCC with peripheral blood mononuclear cells. ADCC activity of 2H7 scFv (SSS-S) H WCH2 WCH3 or Rituximab was measured in vitro against BJAB B lymphoma cell line as the target cells, and using fresh human PBMC as effector cells. Effector to target ratios were varied as follows: 100:1, 50:1, and 25:1, with the number of BJAB cells per well remaining constant but varying the number of PBMC. BJAB cells were labeled for 2 hours with $^{51}Cr$ and aliquoted at a cell density of $5\times10^4$ cells/well to each well of flat-bottom 96 well plates. Purified fusion proteins or Rituximab were added at a concentration of 10 μg/ml, and PBMC were added at 1.25× $10^6$ cells/well (25:1), $2.5\times10^6$ cells/well (50:1), or $5\times10^6$ cells/well (100:1), in a final volume of 200 μl. Natural killing was measured at each effector:target ratio by omission of the construct or MAb. Spontaneous release was measured without addition of PBMC or fusion protein, and maximal release was measured by the addition of detergent (1% NP-40) to the appropriate wells. Reactions were incubated for 5 hours, and 100 μl culture supernatant harvested to a Lumaplate (Packard Instruments) and allowed to dry overnight prior to counting cpm released on a Packard Top Count NXT Microplate Scintillation Counter. FIG. 75 illustrates that the 2H7 scFv (SSS- S) H WCH2 WCH3 construct bound soluble CD16 fusion protein (constructed from either high or low affinity alleles (158V/F)), while the 2H7 scFv (SSS-S) H P238SCH2 WCH3 construct did not show detectable binding. CD20 CHO cells (106) were incubated with saturating amounts of 2H7 scFv (SSS-S) H WCH2 WCH3 or 2H7 scFv (SSS-S) H P238SCH2 WCH3 (10 ug/ml) for one hour on ice in PBS/2% FBS. Cells were washed in PBS/2% FBS and incubated with serial dilutions of 0.5 mg/ml FITC-CD16 for one hour on ice. Cells were washed and specific binding measured by flow cytometry using a Beckman-Coulter Epics C machine. Results were analyzed using Expo analysis software and normalized fluorescence units graphed as a function of concentration. FIG. 76 illustrates an experiment on the ability of 2H7 scFv (SSS-S) H WCH2 WCH3 and 2H7 scFv (SSS-S) H P238SCH2 WCH3 constructs to bind U937 cells. U937 cells (106) expressing CD64 were incubated in PBS/2% FBS for one hour on ice with 2H7 scFv (SSS-S) H WCH2 WCH3 or 2H7 scFv (SSS-S) H P238SCH2 WCH3. Cells were washed and incubated for one hour on ice with FITC-goat anti-human IgG1 (Fc specific) (Caltag) at a final dilution of 1:100. Cells were washed and fluorescence analyzed on a Beckman-Coulter EpicsC flow cytometer. Data was analyzed using Expo analysis software, and fluorescence intensity graphed as a function of the concentration of 2H7 scFv (SSS-S) H WCH2 WCH3 or 2H7 scFv (SSS-S) H P238SCH2 WCH3. This figure shows that both the 2H7 scFv (SSS-S) H WCH2 WCH3 construct and the 2H7 scFv (SSS-S) H P238SCH2 WCH3 construct bound to U937 cells with equivalent titration curves. The results indicated that the 2H7 scFv (SSS-S) H P238SCH2 WCH3 construct was not impaired in its binding to the high affinity Fc receptor FcγRI (CD64). The fact that binding to high affinity FcγRI on U937 cells was similar for the two molecules in this experiment indicated that the P238S amino acid change selectively reduced the binding to FcγRIII. FIG. 77 illustrates B cell depletion in macaques mediated by a anti-CD20 construct (2H7 scFv (SSS-S) H WCH2 WCH3) and a anti-CD20) scFv with a CH2 domain mutation. 2H7 scFv (SSS-S) H WCH2 WCH3 or 2H7 scFv (SSS-S) H P238SCH2 WCH3 were administered to macaques (*M. fasicularis*) by intravenous injection at 6 mg/kg, with two infusions given one week apart. The effect on circulating B cells was measured by detection of CD40 positive B cells in peripheral blood. Blood samples were drawn from injected animals at days 7, 0, 1, 3, 7, 8, 10, 14, 28, and 43. B cell depletion was estimated by performing CBC (complete blood counts) and two-color flow cytometry analysis on monkey blood. FITC or PE conjugates of antibodies against CD40, CD19, CD20, IgG, CD3, CD8 were used in various combinations. Data are plotted as the number of CD40 positive blood B cells tabulated in thousands of cells per microliter over time relative to the initial pre-injection time point level of B cells (maximum). This experiment showed that 2H7 scFv (SSS-S) H WCH2 WCH3 scFv injection resulted in rapid and complete depletion of circulating B cells that lasted longer than 28 days following the second injection. Injection of 2H7 scFv (SSS-S) H P238SCH2 WCH3 scFv did not completely deplete B cells even though CD20 epitopes were saturated. A slow reduction in B cells to approximately 50% of initial levels was observed during the first 2 weeks, but B cells rapidly returned to starting levels in these animals. These results indicate that the ability to bind high affinity FcγRI and to mediate complement dependent cytotoxicity is not sufficient for a CytoxB20G molecule to completely deplete circulating B cells, and that ADCC mediated by interaction with CD16 is likely necessary for rapid and sustained B cell depletion.

These experiments indicated that the 2H7 scFv (SSS-S) H WCH2 WCH3 scFvs are able to trigger B cell depletion functions through three different mechanisms of action (1) induction of apoptosis, (2) CDC effector mechanisms, and (3) ADCC effector mechanisms. All three of these mechanisms probably contribute to depletion of B cells in vivo. The data indicate that complete and sustained depletion of B cells requires intact ADCC effector mechanisms. However, the partial depletion obtained with an ADCC negative mutant also indicates that apoptosis and CDC mechanisms contribute to mediating a portion of the total B cell depletion effects. The results support the use of 2H7 scFv (SSS-S) H WCH2 WCH3 scFv in patients with a CD20 positive B cell malignancy or autoimmune disease.

Example 162

Induction of Apoptosis in B Cells by Anti-CD37 GS-1 VL11S scFv (SSS) H WCH2WCH3 Constructs In this Example, anti-CD37 GS-1 VL11S scFv (SSS) H WCH2WCH3 constructs were evaluated for their ability to bind target cells and for their ability to induce apoptosis. The constructs were also physically characterized by size-exclusion chromatography (SEC). FIG. 78 illustrates the SEC profile of G28-1 (anti-CD37) constructs having SSC hinge domain forms (GS-1 VL11S scFv (SSC) H WCH2WCH3). G28-1 (anti-CD37) constructs were purified from CHO culture supernatants by Protein A affinity chromatography. Purified aliquots of 10-25 mg were subjected to HPLC over a Tosoh Biosep, Inc. TSK 3000 SWXL HPLC column, pore size 5 mm. The flow rate was 1 ml/min, in PBS, pH 7.2 running buffer. Migration rates of molecular weight standards are indicated below the tracing. The GS-1 VL11S scFv (SSS) H WCH2WCH3 construct is indicated in blue, while the GS-1 VL11S scFv (SSC) H WCH2WCH3 construct is indicated in red. The GS-1 VL11S scFv (SSS) H WCH2WCH3 construct generated a uniform peak of approximately 75-100 kDa, while the GS-1 VL11S scFv (SSC) H WCH2WCH3 construct generated a smaller form and other heterogeneous forms, including a high molecular weight form greater than 200 kDa. FIG. 79 illustrates the binding of G28-1 (anti-CD37) constructs to B cell lymphoma cell lines. Serial dilutions of purified GS-1 VL11S scFv (SSS) H WCH2WCH3 or GS-1 VL11S scFv (SSC) H WCH2WCH3 were incubated with $10^6$ cells of each cell type for 60 minutes on ice in PBS/2% FBS. Samples were washed twice, and incubated with a mixture of FITC goat anti-human IgG and FITC goat anti-human IgG F(ab')$_2$ (CalTag) at 1:100 each, on ice for 45 minutes. Samples were washed and analyzed by flow cytometry using a FACsCalibur (Becton-Dickinson). The results of this experiment show that both GS-1 VL11S scFv (SSS) H WCH2WCH3 and GS-1 VL11S scFv (SSC) H WCH2WCH3 constructs bound to BJAB and Ramos cells, and moderately to WIL-2 cells. G28-1 (anti-CD37) (SSS) H G scFv or G28-1 (SSC) H G scFv constructs molecules bound Raji and Namalwa cells at lower levels in these experiments. Binding to all lines was significant because background fluorescence has been subtracted from the data shown in FIG. 79. FIG. 80 illustrates the binding of annexin and v-propidium iodide to Ramous cells after overnight incubation with GS-1 VL11S scFv (SSS) H WCH2WCH3 or GS-1 VL11S scFv (SSC) H WCH2WCH3 forms of scFvs. AnnexinV-PI staining of Ramos Cells incubated for 24 hours with G28-1 (anti-CD37) scFvs. Ramos B cells at $10^6$ cells/ml were incubated in 12 well dishes for 24 hours with G28-1 (anti-CD37) scFvs at 10 mg/ml, in a total volume of 2 ml. Cells were stained with annexinV and propidium iodide with a kit obtained from Immunotech, according to manufacturer's instructions. Samples were analyzed by two-color flow cytometry using a FACsCalibur flow cytometer (Becton-Dickinson). The % of the total cells in each quadrant is indicated next to each dot plot. FIG. 83 shows the binding of Annexin V-Propidium Iodide to cells after overnight incubation with GS-1 VL11S scFv (SSS) H WCH2WCH3 or GS-1 VL11S scFv (SSC) H WCH2WCH3. The results indicated that both GS-1 VL11S scFv (SSS) H WCH2WCH3 and GS-1 VL11S scFv (SSC) H WCH2WCH3 constructs were able to induce apoptosis, but that the SSC form induced more apoptosis than the SSS form. FIG. 81 illustrates the inhibition of proliferation of Ramos cells grown in the presence of G28-1 (anti-CD37) constructs. Ramos B cells were incubated with serial dilutions of purified G28-1 (anti-CD37) constructs containing either the IgG1 hinge identified as (SSS) H or (SSC) H. Cultures were incubated in 96 well flat bottom tissue culture dishes (Costar) at 37° C., 5% $CO_2$ for 36 hours prior to pulsing with 3H-thymidine for the last 12 hours of a 48 hour incubation (0.75 mCi/well). Cells were harvested onto 96-well GFC plates using a Packard harvester, dried, and 25 ml Microscint scintillation fluid added to each well prior to counting on a Top-Count NXT microplate (Packard) scintillation counter. Data are plotted as cpm incorporated versus protein concentration. Each construct showed increasing inhibition of proliferation with increasing protein concentration. FIG. 82 illustrates the induction of apoptosis in Ramos B cells cultured in the presence of and 2H7 (anti-CD20) and G28-1 (anti-CD37) constructs. Ramos B cells were incubated with CD20 and/or CD37 targeted constructs (10 mg/ml) in solution for 20 hours. The cells were then harvested, washed, and incubated in annexinV and propidium iodide using a staining kit from Immunotech prior to two color flow cytometry using a FACsCalibur flow cytometer (Becton-Dickinson). The graph shows the percentage of annexin V positive cells identified by their staining in the right quadrants of the dot plots. The results of this experiment indicate that the both G28-1 constructs were more efficient than the 2H7 construct and that the G28-1 VL11S scFv (SSS) H WCH2 WCH3 construct was more efficient than the G28-1 VL11S scFv (SSC) H WCH2 WCH3 construct. However, the amount of apoptosis of Ramos cells was greatest when the 2H7 and the G28-1 constructs were used in combination. FIG. 83 illustrates the killing of Ramos cells by complement dependent cytotoxicity (CDC) induced by 2H7 (anti-CD20) constructs and G28-1 (anti-CD37) constructs with hinge region mutations. 2H7 scFv (CSS-S) H WCH2 WCH3 (anti-CD20), G28-1 scFv (SSS) H G, G28-1 (SCS)H (anti-CD37-scFv), G28-1 (CSS)H (anti-CD37-scFv), or G28-1 (SSC) H (anti-CD37-scFv) were incubated at 10 mg/ml with $10^4$ Ramos Target Cells and a 1:10 dilution of rabbit complement (PelFreez) in a volume of 150 ml for 90 minutes. Aliquots were stained with trypan blue (Invitrogen), and counted using a hemacytometer to determine the percentage of the cell population killed during treatment. Negative controls with cells and only one reagent were also included. Both G28-1 (SSS) (anti-CD37 scFv) and G28-1 (SSC) (anti-CD37 scFv) rapidly killed Ramos cells in the presence of rabbit complement in this experiment. The activity of G28-1 (SSC) (anti-CD37 scFv) was higher than that of G28-1 (SSS) (anti-CD37 scFv), and was nearly as potent in this assay as the CD20-directed 2H7 scFv (CSS-S)H WCH2 WCH3 scFv molecule. FIG. 84 illustrates the induction of ADCC of Ramos cells incubated with G28-1 (anti-CD37) scFvs. G28-1 (anti-CD37) constructs at 10 mg/ml were incubated in flat-bottom 96 well plates with $10^4$ $^{51}$Cr-labeled Ramos cells and resting human PBMCs at different effector:target ratios ranging from 0 to 100. All incubations were performed in triplicate at each effector:target ratio. Natural killing was measured at each effector:target ratio by omission of the constructs. Spontaneous release was measured without addition of PBMC or fusion protein, and maximal release was measured by the addition of detergent (1% NP-40) to the appropriate wells. Reactions were incubated for 6 hours, and 100 ml culture supernatant harvested to a Lumaplate (Packard Instruments) and allowed to dry overnight prior to counting cpm released on a Packard Top Count NXT Microplate Scintillation Counter. Results from these experiments indicated that the G28-1 (anti-CD37) constructs bind to target cells, that they induce apoptosis in the B cell lines, and that they mediate effector functions including CDC and ADCC.

Additional non-limiting representative constructs or sequences within, or useful within, the present inventions are as follows:

```
HuIgG1 wild type hinge. CH2, CH3 (nucleotide sequence) (SEQ ID NO: 1)
tctgatcaggagcccaaatcttgtgacaaaactcacacatgcccaccctgaactcctgggggaccgtcagtctt
cctcttccccccaaaacccaaggacaccctcatgatctcccggacccctgaggtcacatgcgtggtggtggacgtgagccacgaa
gaccctgaggtcaagttcaactggtacgtggacggcgtggaggtgcataatgccaagacaaagccgcgggaggagcagtacaa
cagcacgtaccgtgtggtcagcgtcctcaccgtcctgcaccaggactggctgaatggcaaggagtacaagtgcaaggtctccaac
aaagcctcccagcccccatcgagaaaacaatctccaaagccaaagggcagccccgagaaccacaggtgtacaccctgcccc
atcccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggctccttcttcctctacagcaag
ctcaccgtggacaagagcaggtggcagcaggggaacgtcttctcatgctccgtgatgcatgaggctctgcacaaccactacacgc
agaagagcctctccctgtctccgggtaaatgatctaga HuIgG1 wild type hinge, CH2, CH3 (amino acid sequence) (SEQ ID NO: 2)
SDQEPKSCDKTHTCPPCPAPELLGGPSVFLFPPKPKDTLMISRTPEVTCVVVDVSHE
DPEVKFNVYVDGVEVHNAKTKPREEQYNSTYRVVSVLTVLHQDWLNGKEYKCK
VSNKALPAPIEKTISKAKGQPREPQVYTLPPSRDELTKNQVSLTCLVKGFYPSDIAV
EWESNGQPENNYKTTPPVLDSDGSFFLYSKLTVDKSRWQQGNVFSCSVMHEALH
NHYTQKSLSLSPGK Llama IgG1 hinge, CH2, CH3 (nucleotide sequence) (SEQ ID NO: 3)
tgatcaagaaccacatggaggatgcacgtgcccncagtgcccncaatgccccttgcncngaactccaggaggcccttctgtcttt
gtcttccccccgaaacccaaggacgtcctctccattttggaggccgagtcacgtgcgttgtagtggacgtcggaaagaaagaccc
cgaggtcaatttcaactggtatattgatgcgcttgaggtgcgaacggccaatacgaagccaaagaggaacagttcaacagcacg
taccgcgtggtcagcgtcctgcccatccagcaccaggactggctgacggggaaggaattcaagtgcaaggtcaacaacaaagct
ctcccggcccccatcgagaggaccatctccaaggccaaagggcagacccgggagccgcaggtgtacaccctggccccacacc
gggaagaactggccaaggacaccgtgagcgtaacatgcctggtcaaaggcttctacccagctgacatcaacgttgagtggcaga
```

-continued ggaacggtcagccggagtcagagggcacctacgccaacacgccgccacagctggacaacgacgggacctacttcctctacagc
aagctctcggtggggaaagaacacgtggcagcggggagaaaccttaacctgtgtggtgatgcatgaggccctgcacaaccactac
acccagaaatccatcacccagtcttcgggtaaatagtaatctaga Llama IgG1 hinge, CH2, CH3 (in FIG. 23 as Llama IgG1 (amino acid sequence) (SEQ ID NO: 4)
EPHGGCTCPQCPQCPAPAPELPGGPSVFFPPKPKDVLSISGRPEVTCVVVDVGKEDPEVN
FNWYDGVEVRTANTKPKEEQFNSTYRVVSVLPIQHQDWLTGKEFKCKVNNKAL
PAPIERTISKAKGQTREPQVYTLAPHREELAKDTVSVTCLVKGFYPADINVEWQRN
GQPESEGTYANTPPQLDNDGTYFLYSRLSVGKNTWQRGETLTGVVMHEALHNHY
TQKSITQSSGK Llama IgG2 (nucleotide sequence) (SEQ ID NO: 5)
tgatcaagaacccaagacaccaaaaccacaaccacaaccacaaccacaaccacaaccacaaccccaatcctacaacagaatccaagtgtcccaaatgt
ccagcccctgagctcctgggagggccctcagtcttcatcttccccccgaaacccaaggacgtcctctccatttctggaggcccga
ggtcacgtgcgttgtggtagacgtgggccaggaagacccccgaggtcagtttcaactggtacattgatggcgctgaggtgcgaacg
gccaacacgaggccaaaagaggaacagttcaacagcacgtaccgcgtggtcagcgtcctgcccatccagcaccaggactggct
gacggggaaggaattcaagtgcaaggtcaacaacaaagctctcccggccccatcgagaaggaccatctccaaggccaaagggc
agaccgggagccgcaggtgtacaccctggccccacaccgggaagagctggccaaggacaccgtgagcgtaacatgcctggt
caaaggcttctaccacctgatatcaacgttgagtggcagaggaatgggcagccggagtcagagggcacytacgccaccacgc
cacccagctggacaacgacgggacctacttcctctacagcaagctctcggtggggaaagaacacgtggcagcagggagaaacc
ttcacctgtgtggtgatgcacgaggccctgcacaaccactacacccagaaatccatcacccagtcttcgggtaaatagtaatctaga.

Llama IgG2 (amino acid sequence) (SEQ ID NO: 6)
DQEPKTPKPQPQPQPQPNPTTESKCPKCPAPELLGGPSVFIFPPKYKDVLSISGRPEV
TCVVVDVGQEDPEVSFNWYIDGAEVRTANTRPKEEQFNSTYRVVSVLPIQHQDWL
TGKEFKCKVNNKALPAPIEKTISKAKGQTREPQVYTLAPHREELAKDTVSVTCLVK
GFYIPDINVEWQRNGQPESEGTYATTPPQLDNDGTYFLYSKLSVGKNTWQQGETF
TCVVMHIEALHNHYTQKSITQSSGK Llama IgG3 Fc (nucleotide sequence) (SEQ ID NO: 7)
tgatcaagcgcaccacagcgaagaccccagctccaagtgtcccaaatgcccaggccctgaactcctggagggcccacggtctt
catcttccccccgaaagccaaggacgtcctctccatcacccgaaaacctgaggtcacgtgcttgtggtggacgtgggtaaagaag
acccctgagatcgagttcaagctggtccgtggatgacacagaggtacacacgggctgagacaaagccaaggaggaacagttcaac
agcacgtaccgcggtggtcagcgtcctgcccatccagcaccaggactggctgacggggaaggaattcaagtgcaaggtcaacaa
caaagctctcccagcccccatcgagaggaccatctccaaggccaaaggggcagaccccggagccgcaggtgtacaccctggcc
ccacaccgggaagagctggccaaggacaccgtgagcgtaacctgcctggcaaaggcttcttccagctgacatcaacgttgagt
ggcagaggaatgggcagccggagtcagagggcacctacgccaacacgccgccacagctggacaacgacgggacctacttcct
ctacagcaaactctccgtggggaaagaacacgtggcagcagggagaagtcttcacctgtgtggtgatgcacgaggctctacacaat
cactccacccagaaatccatcacccagtctttcgggtaaatagtaatctagagggccc Llama IgG3 Fc (amino acid sequence) (SEQ ID NO: 8)
DQAHHSEDPSSKCPKCPGPELLGGPTVFIFPPKAKDVLSITRKPEVTCLWWTWVKK
TLRSSSSWSVDDTEVHTAETKPKEEQFNSTYRVVSVLPIQHQDWLTGKEFKCKVN
NKALPAPERTISKAKGQTREPQVYTLAPHREELAKDTVSVTCLVKGFFPADINVE
WQRNGQPESEGTYANTPPQLDNDGTYFLYSKLSVGKNTWQQGEVFTCVVMHEA
LHNHSTQKSITQSSGK.

HuIgG1 wild type hinge (nucleotide sequence) (SEQ ID NO: 9)
gatcaggagcccaaatcttgtgacaaaactcacacatgcccaccgtgcccagca HuIgG1 wild type hinge (amino acid sequence) (SEQ ID NO: 10)
DQEPKSGDKTHTCPPCPA HuIgG1 H2, wild type hinge with leu at second position (nucleotide sequence) (SEQ ID NO: 11)
gatctggagcccaaatcttgtgacaaaactcacacatgcccaccgtgcccagca HuIgG1 H2, wild type hinge with leu at second position (amino acid sequence) (SEQ ID NO: 12)
DLEPKSCDKTHTCPPCPA NTHuIgG1 wild type CH2 (nucleotide sequence) (SEQ ID NO: 13)
cctgaactcctggggggaccgtcagtcttcctcttccccccaaaacccaaggacaccctcatgatctcccggaccctgaggtcac
atgcgtggtggtggacgtgagccacgaagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgcaaggtctccaacaaagcccctcccagcccccatcgagaaaaccatctccaaagccaaa HuIgG1 wild type CH2 (amino acid sequence) (SEQ ID NO: 14)
PELLGGPSVFLFPPKPKDTLMISRTPEVTCVVVDVSHEDPEVKYNWYVDGVEVHN
AKTKPREEQYNSTYRVVSVLTVLHQDWLNGKEYKCKVSNKALPAPLEKTISKAK HuIgG1 wild type CH3 (nucleotide sequence) (SEQ ID NO: 15)
gggcagccccgagaaccacaggtgtacaccctgccccatcccgggaggagatgaccaagaaccaggtcagcctgacctgcct
ggtcaaaggcttctatcccagcgacatcgccgtggagtgggagagcaatgggcagccggagaacaactacaagaccacgcctc
ccgtgctggactccgacggctccttcttcctctatagcaagctcaccgtggacaagagcaggtggcagcaggggaacgtcttctca
tgctccgtgatgcatgaggctctgcacaaccactacacgcagaagagcctctccctgtccccgggtaaatga HuIgG1 wild type CH3 (amino acid sequence) (SEQ ID NO: 16)
GQPREPQVYTLPPSREEMTKNQVSLTCLVKGFYPSDIAVEWESNGQPENNYKITPP
VLDSDGSFFLYSKLTVDKSRWQQGNVFSCSVMHEALHNHYTQKSLSLSPGK -continued HuIgG1 mutated hinge (C-C-C→S-S-S) (nucleotide sequence) (SEQ ID NO: 17)
gatcaggagcccaaatcttctgacaaaactcacacatccccaccgtccccagca HuIgG1 mutated hinge (C-C-C→S-S-S) (amino acid sequence) (SEQ ID NO: 18)
DQEPKSSDKTHTSPPSPA HIgG1MTH WTCH2CH3 (mutant hinge with wild type CH2 and CH3 (reads from
the hinge + Ig tail) (nucleotide sequence) (SEQ ID NO: 19)
tgatcacccccaaatcttctgacaaaactcacacatctccaccgtcctcagcacctgaactcctgggtggaccgtcagtgttcctcttcc
ccccaaaacccaaggacaccctcatgatctcccggacccctgaggtcacatgcgtggtggacgtgagccacgaagaccctg
aggtcaagttcaactggtacgtggacggcgtggaggtgcataatgccaagacaaagccgcgggaggagcagtacaacagcacg
taccgtgtggtcagcgtcctcaccgtcctgcaccaggactggctggtgaatggcaaggagtacaagtgcaaggtctccaacaaagcc
ctcccagcccccatcgagaaaacaatctccaaagccaaagggcagccccgagaaccacaggtgtacaccctgcccccatcccgg
gatgagctgaccaagaaccaggtcagcctgacctgcctggtcaaaggcctctatcccagcgacatcgccgtggagtgggagagc
aatgggcagccggagaacaactacaagaccacgcctcccgtgctggactccgacggctccttcttcctctacagcaagctcaccg
tggacaagagcaggtggcagcaggggaacgtcttctcatgctccgtgatgcatgaggctctgcacaaccactacacgcagaaga
gcctctccctgtctccgggtaaatgataatctaga Mutant hinge, but wild type CH2 and CH3 (amino acid sequence) (SEQ ID NO: 20)
DHPKSSDKTHTSPPSSAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVS
NKALPAPIEKTISKAKGQPREPQVYTLPPSRDELTKNQVSLTCLVKGFYPSDIAVEW
ESNGQPENNYKTTPPVLDSDGSFFLYSKLTVDKSRWQQGNVFSCSVMHEALHNH
YTQKSLSLSPGK 2H7 scFv llama IgG1 (nucleotide sequence) (SEQ ID NO: 21)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtaagttacatgcact
ggtaccagcagaagccaggatcctcccccaaacctggatttatgcccatccaacctggcttctggagtccctgctcgcttcagtg
gcagtgggtctgggacctcttactctctcacaatcagcagagtggaggctgaagatgctgccacttattactgccagcagtggagttt
aacccaccacgttcggtgctgggaccaagctggagctgaaagatggcggtggctcggccggtggtggatctgaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagtcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctgggcac
agggaccacggtcaccgtctcttctgatcaagaaccacatggaggatgcacgtgcccncagtgcccncagtgcccngcnccng
aactnccaggaggccctctctgtcttttgtcttccccccgaaaccaaggactgtcctcctcatttttgcaggccgagtcacgtgcgttgt
agtgggacgtcggaaagaaagaccccgaggtcaatttcaactggtatattgatggcgttgagtgcgaacgtcaatacgaagcca
aaagaggaacagttcaacagcacgtaccgcgtggtcagcgtcctgcccatccagcaccaggactggctgacggggaaggaatt
caagtgcaaggtcaacaacaaagctctcccggcccccatcgagaggaccatctccaaggccaaagggcagacccccgggagccg
caggtgtacaccctggcccccaccgggaagaactggccaaggacaccgtgagcgtaacatgcctggtcaaaggcttctaccca
gctgacatcaacgttgagtggcagaggaacggtcagccggagcagcaggggaacctacgccaacacgccgccacagctggaca
acgacgggacctacttcctctacagcaagctctcggtgggaaagaacacgtggcagcggggagaaacctaacctgtgtggtgat
gcatgaggcccctgcacaaccactacacccagaaatccatcacccagtcttcgggtaaatagtaatctaga 2H7 scFv llama IgG1 (amino acid sequence) (SEQ ID NO: 22)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPHGGCT
CQPCPAPELPGGPSVFVFPPKPKDVLSIFGGRVTCVVVDVGKKDPEVNFNWYIDGV
EVRTANTKPKEEQFNSTYRVVSVLPIQHQDWLTGKEFKCKVNNKALPAPIERTISK
AKGQTREPQVYTLAPHREELAKDTVSVTCLVKGFYPADINVEWQRNGQPESEGTY
ANTPPQLDNDGTYFLYSKLSVGKNTWRGETLTCVVMHEALHNHYTQKSITQSS
GK 2H7 scFv llama IgG2 (nucleotide sequence) (SEQ ID NO: 23)
aagcttgccgccsrggattttcaagtgcagattttcagcttcctgctaatcagtgcttcagtcataattgccagaggacaaattgttgttctct
ccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
aacccaccacgttcggtgctgggaccaagctggagctgaaagatggcggtggctcggccggtggtggatctgaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagtcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctgggcac
agggacaacggtcaccgtctcttctgatcaagaacccaagacaccaaaaccacaaccacaaccacaacccaatcctac
aacagaatccaagtgtcccaaatgtccagcccctgagcctgggagggcccctcagtcttcatcttcccccgaaacccaaggac
gtcctctccatttctgggagccccgaggtcacgtgcgttgtggtagacgtgggccaggaagaccgaggtcagtttcaactggta
cattgatggcgctgaggtgcgaacggccaacacgaggcaaaagaggaacagttcaacagcacgtaccgcgtggtcagcgtcc
tgcccatccagcaccaggactggctgacggggaaggaattcaagtgcaaggtcaacaacaaagctctcccggcccccatcgag
aagaccatctccaaggccaaagggcagacccgggagccgcaggtgtacaccctggcccacaccgggaagagctggccaag
gacaccgtgagcgtaacatgcctggtcaaaggcttctaccactcctgatatcaacgttgagtggcagaggaatgggcagccggagt
cagagggcacytacgccaccacgccaccccagctggacaacgacgggaccttacttcctctacagcaagctctcggtgggaaag
aacacgtggcagcagggagaaacctcacctgtgtggtgatgcacgaggccctgcacaaccactacacccagaaatccatcacc
cagtcttcgggtaaatagtaatctaga AA2H7 scFv llama IgG2 (amino acid sequence) (SEQ ID NO: 24)
MDFQVQIFSFLLISASVILARGQIVLSQSPAILSASPGEKVTMTCRASSSVSYMHWY
QQKPGSSSPKPWIYAPSNLASGVPARFSGSGSGTSYLTISRVEAEDAATYYCQQWS
FNPPTFGAGTKKLELKDGGGSGGGGSGGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWTGTGTTVTVSSDQEPKTPKP
QPQPQPQPNPTTESKCPKCPAPEKKGGPSVFIFPPKPKDVLSISGRPEVTCVVVDVG
QEDPEVSFNWYIDGAEVRTANTRPKEEQFNSTYRVVSVLPIQHQDWLTGKEFKCK
VNNKALPAPIEKTISKAKGQTREPQVYTLAPHREELAKDTVSVTCLVKGFYPPDIN
VEWQRNGQPESEGTYATTPPQLDNDGTYFLYSKLSVGKNTWQQGETFTCVVMHE
ALHNHYTQKSITQSSGK NT2H7 scFv llama IgG3 (nucleotide sequence) (SEQ ID NO: 25)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccacgttcggtgctgggaccaagctggagctgaaagatggcggtggctcgggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctgggcac
agggaccacggtcaccgtctcttctgatcaagcgaaccacagcgaagaccccagctccaagtgtcccaaatgcccaggccctga
actccttggagggcccacggtcttccccccgaaagccaaggacgtcctctccatcacccgaaaacctgaggtcacgtgctt
gtggtggacgtgggtaaagaagaccctgagatcgagttcaagctggtccgtggatgacacagaggtacacagaggtacacacggctgagacaa 2H7 scFv llama IgG3 (amino acid sequence) (SEQ ID NO: 26)
MDFQVQIFSFLLISASVILARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQAHSHSED
PSSKCPKCPGPELLGGPTVFIFPPPKAKDVLSITRKPEVTCLWWTWVKKTLRSSSSW
SVDDTEVHTAETKPKEEQFNSTYRVVSVLPIQHQDWLTQKEFKCKVNNKALPAPI
ERTISKAKGQTREPQVYTLAPHREELAKDTVSVTCLVKGFPPADINVEWQRNGQP
ESEGTYANTPPQLDNDGTYFLYSKLSVGKNTWQQGEVETCVVMHEALHNHSTQK
SITQSSGK 2H7 scFv WTH WTCH2CH3 (nucleotide sequence) (SEQ ID NO: 27)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccacgttcggtgctgggaccaagctggagctgaaagatggcggtggctcgggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagtcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctgggcac
agggaccacggtcaccgtctcttctgatcaggagcccaaatcttgtgacaaaactcacacatgcccaccgtgcccagcacctgaac
tcctgggggaccgtcagtcttcctcttccccccaaaacccaaggacaccctcatgatctcccggacccctgaggtcacatgcgtg
gtggtgacgtgagccacgaagaoctgaggtcaagttcaactggtacgtggacggcgtggaggtgcataatgccaagacaaag
ccgcggaggagcagtacaacagcacgtaccgtgtggtcagcgtcctcaccgtcctgcaccaggactggctgaatggcaagga
gtacaagtgcaaggtctccaacaaagcccctcccagcccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv WTH WTCH2CH3 (amino acid sequence) (SEQ ID NO: 28)
MDFQVQIFSFLLISASVILARGQIVLSQSPAILSASPGEKVTMMTCRASSSVSYMHWY
QQKPGSSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYYFDVWGTGTTVTVSSDQEPKSCDK
THTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFKYSKLTVDKSRWQQGNVFSCSVMHEALHNHYTQKSLSL
SPGK NTCD80 transmembrane domain and cytoplasmic tail (+ restriction sites) (nucleotide
sequence) (SEQ ID NO: 29)
gcggatccttcgaacctgctcccatcctgggccattaccttaatctcagtaaatggaatttttgtgatatgctgcctgacctactgctttg
ccccaagatgcagagagagaaggaggaatgagagattgagaagggaaagtgtacgccctgtataaatcgat CD80 transmembrane domain and cytoplasmic tail (amino acid sequence) (SEQ ID NO: 30)
ADPSNLLPSWAITLISVNGIFVICCLTYCFAPRCRERRRNERLRRESVRPV -continued 40.2.220 VL (anti-human CD40 scFv #1-VL) (nucleotide sequence) (SEQ ID NO: 31)
aagcttatggattttcaagtgcagattttcagcttcctgctaatcagtgcttcagtcataagtccagaggagtcgacattgttctgactc
agtctccagccaccctgtctgtgactccaggagctagagtctctctttcctgcagggccagccagagtattagcgactacttacactg
gtatcaacaaaaatcacatgagtctccaaggcttctcatcaaatatgcttcccattccatctctgggatcccctccaggttcagtggca
gtggatcagggtcagatttcactctcagtatcaacagtgtggaacctgaagatgttggaatttattactgtcaacatggtcacagcttc
cgtggacgttcggtggaggcaccaagctggaaatcaaacgg 40.2.220 VL (anti-human CD40 scFv #1--VL) (amino acid sequence) (SEQ ID NO: 32)
MDFQVQWSFLLISASVIMSRGVDWLTQSPATLSVTPGDRVSLSCPASQSISDYLHW
YQQKSHESPRLLIKYASHSISGIPSRFSGSGSGSDFTLSTNSVEPEDVGIYYCQHGHSF
PWTFGGGTKLEIKR 40.2.220 VH (for anti-human CD40 scFv #1-VH) (nucleotide sequence) (SEQ ID NO: 33)
cagatccagttggtgcaatctggacctgagctgaagaagcctggagagacagtcaggatctcctgcaaggcttctgggtatgcctt
cacaactactggaatgcagtgggtgcaagagatgccaggaaagggtttgaagtggattggctggataaacaccccactctggagt
gccaaatatgtagaagacttcaaggacggtttgccttctctttggaaacctctgccaacactgcatatttacagataagcaacctcaa
agatgaggacacggctacgtatttctgtgtgagctccgggaatggtaactatgacctggcctactttgcttactggggccaagggac
actggtcactgtctctgatca 40.2.220 VH (for anti-human CD40 scFv #1--VH) (amino acid sequence) (SEQ ID NO: 34)
QIQLVQSGPELKKPGETVRISCKASGYAFTTTGMQWVQEMPGKGLKWIGWINTPL
WSAKICRRLQGRFAFSLETSANTAYLQISNLKDEDTATYFCVRSGNGNYDLAYFA
YWGQGTLVTVS 40.2.220 scFv (anti-human CD40 scFv #1) (nucleotide sequence) (SEQ ID NO: 35)
aagcttatggattttcaagtgcagattttcagcttcctgctaatcagtgcttcagtcataagtccagaggagtcgacattgttctgactc
agtctccagccaccctgtctgtgactccaggagatagagtctctctttcctgcagggccagccagagtattagcgactacttacactg
gtatcaacaaaaatcacatgagtctccaaggcttctcatcaaatatgcttcccattccatctctgggatcccctccaggttcagtggca
gtggatcagggtcagatttcactctcagtatcaacagtgtggaacctgaagatgttggaatttattactgtcaacatggtcacagcttc
cgtggacgttcggtggaggcaccaagctggaaatcaaacggggcggagggtcaggcggaggtggctctggcggtggcggatcg
gatctcagatccagttggtgcaatctggacctgagctgaagaagcctggagagacagtcaggatctcctgcaaggcttctgggtat
gccttcacaactactggaatgcagtgggtgcaagagatgccaggaaagggtttgaagtggattggctggataaacaccccactctg
gagtgccaaatatgtagaagacttcaaggacggtttgccttctctttggaaacctctgccaacactgcatatttacagataagcaacc
tcaaagatgaggacacggctacgtatttctgtgtgagatccgggaatggtaactatgacctggcctactttgcttactggggccaag
ggacactggtcactgtctctgatca 40.2.220 scFv (anti-human CD40 scFv #1) (amino acid sequence) (SEQ ID NO: 36)
MDFQVQWSFLLISASVIMSRGVDIVLTQSPATLSVTPGDRVSLSCRASQSISDYLHW
YQQKSHESPRLLIKYASHSISGIPSRFSGSGSGSDFTLSIINSVEPEDVGIIYYCQHGHSF
PWTFGGGTKLEIKRGGGGSGGGGSGGGGSQIQLVQSGPELKKPGETVRISCKASG
YAFTTTGMQWVQEMPGKGLKWIGWINTPLWSAKICRRLQGRFAFSLETSANTAY
LQISNLKDEDTATYFCVRSGNGNYDLAYFAYWGQGTLVTVS 2e12 VL (with L6 VK leader peptide) (nucleotide sequence) (SEQ ID NO: 37)
atggattttcaagtgcagattttcagcttcctgctaatcagtgcttcagtcataatgtccagaggagtcgacattgtgctcacccaatctc
cagcttctttggctgtgtctctaggtcagagagccaccatctcctgcagagccagtgaaagtgttgaatattatgtcacaagtttaatgc
agtggtaccaacagaaaccaggacagccacccaaactcctcatctctgctgcatccaacgtagaatctggggtccctgccaggttt
agtggcagtgggtctgggacagacttcagcctcaacatccatcctgtggaggaggatgatattgcaatgtatttctgtcagcaaagta
ggaaggttccttggacgttcggtggaggcaccaagctggaaatcaaacgg 2e12 VL (with L6 VK leader peptide) (amino acid sequence) (SEQ ID NO: 38)
MDFQVQIFSFLLISASVIMSRGVDIVLTQSPASLAVSLGQRATLSCRASESVEYYVTS
LMQWYQQKIPGQPPKLLISAASNVESGVPARFSGSGSGTDFSLNIHPVEEDDIAMYF
CQQSRKVPWTFGGGTKLEIKR 2e12 VH (no leader peptide) (nucleotide sequence) (SEQ ID NO: 39)
caggtgcagctgaaggagtcaggacctggcctggtggcgccctcacagagcctgtccatcacatgcaccgtctcagggttctcatt
aaccggctatggtgtaaactgggttcgccagcctccaggaaagggtctggagtggctgggaatgatatgggtgatggaagcac
agactataattcagctctcaaatccagactgagcatcaccaaggacaactccaagagccaagttttcttaaaaatgaacagtctgcaa
actgatgacacagccagatactactgtgccagagatggttatagtaacucauactatgttatggactactggggtcaaggaacctc
agtcaccgtctcctca(gatctg)

2e12 VH (amino acid sequence) (SEQ ID NO: 40)
QVQLKESGPGLVAPSQSLSITCTVSGFSLTGYGVQPPGKGLEWLGMIWGDG
STDYNSALKSRLSITKDNSKSQVFLKNSLQTDDTARYYCARDGYSNFHYYVMD
YWGQGTSVTVSS 2e12scFv(+Restriction sites) (nucleotide sequence) (SEQ ID NO: 41)
aagcttatggattttcaagtgcagattttcagcttcctgctaatcagtgcttcagtcataattccagaggagtcgacattgtctcaccc
aatctccagcttctttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacgggggtggcggttggctcggcggaggtggg
tcgggtggcggcggatctcaggtgcagctgaaggcgtcaggacctggcctggtggcgccctcacagagcctgtccatcacatgc
accgtctcagggttctcattaaccggctatggtgtaaactgggttcgccagcctccaggaaagggtctggagtggctgggaatgat
atgggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctct(gatcag)

-continued

2e12scFv (amino acid sequence) (SEQ ID NO: 42)
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYCARDGYSNFHYYVMDYWGQGTSVTVSS 10A8 is anti-CD152 (CTLA-4)
10A8 VL (with L6 VK leader peptide) (nucleotide sequence) (SEQ ID NO: 43)
atggattttcaagtgcagattttcagcttcctgctaatcagtgcttcagtcataatgtccagaggagtcgacatccagatgacacagtct
ccatcctcactgtctgcatctctgggaggcaaagtcaccatcacttgcaaggcaagccaagacattaagaagtatataggttggtac
caacacaagcctggaaaaggtcccaggctgctcatatattacacatctacattacagccaggcatcccatcaaggttcagtggaagt
gggtctgggagagattattccctcagcatcagaaacctggagcctgaagatattgcaacttattattgtcaacagtatgataatcttcc
attgacgttcggctcggggacaaagttggaaataaaacgg 10A8 VL (amino acid sequence) (SEQ ID NO: 44)
MDFQVQIFSFLLISASVIMSRGVDIQMTQSPSSLSASLGGKVTITCKASQDIKKYIG
WYQHKPGKGPRLLIYYTSTLQPGIPSRFSGSGSGRDYSLSIRNLEPEDIATYYCQQY
DNLPLTFGSGTKLEIKR 10A8 VH (no leader peptide) (nucleotide sequence) (SEQ ID NO: 45)
gatgtacagcttcaggagtcaggacctggcctcgtgaaaccttctcagtctctgtctctcacctgctctgtcactggctactccatcac
cagtggtttctactggaactggatccgacagtttccgggaaacaaactggaatggatgggccacataagccacgacggtaggaat
aactacaacccatctctcataaatcgaatctccatcactcgtgacacatctaagaaccagttttttcctgaagttgagttctgtgactactg
aggacacagctacatatttctgtgcaagacactacggtagtagcggagctatggactactggggtcaaggaacctcagtcaccgtc
tcctctgatca 10A8 VH (amino acid sequence) (SEQ ID NO: 46)
DVQLQEFGPGLVKPSQSLSLTCSVTGYSITSGFYWNWIRQFPGNKLEWMGHISHD
GRNNYNPSLINRISITRDTSKNQFFLKLSSVTTEDTATYFCARHYGSSGAMDYWGQ
GTSVTVSS 10A8 SCFV (nucleotide sequence) (SEQ ID NO: 47)
aagcttatggatttttcaagtgcagattttcagcttcctgctaatcagtgcttcagtcataatgtccagaggagtcgacatccagatgaca
cagtctccatcctcactgtctgcatctctgggaggcaaagtcaccatcacttgcaaggcaagccaagacattaagaagtatataggtt
ggtaccaacacaagcctggaaaaggtcccaggctgctcatatattacacatctacattacagccaggcatcccatcaaggttcagtg
gaagtgggtctgggagagattattccctcagcatcagaaacctggagcctgaagatattgcaacttattattgtcaacagtatgataat
cttccattgacgttcggctcggggacaaagttggaaataaaacgggggtggcggtggctcggcggtggtgggtcggggtggcggc
ggatctgatgtacagcttcaggagtcaggacctggcctcgtgaaaccttctcagtctctgtctctcacctgctctgtcactggctactc
catcaccagtggtttctactggaactggatccgcagtttccgggaaacaaactggaatggatgggccacataagccacgacggta
ggaataactacaacccatctctcataaatcgaatctccatcactcgtgacacatctaagaaccagttttttcctgaagttgagttctgtga
ctactgaggacacagctacatatttctgtgcaagacactacggtagtagcggagctatggactactggggtcaaggaacctcagtc
ctactgaggacacagctacatatttctgtgcaagacactacggtagtagcggagctatggactactggggtcaaggaacctcagtc
accgtctcctctgatca 10A8 SCFV (amino acid sequence) (SEQ ID NO: 48)
MDFQVQIFSFLLISASVIMSRGVDIQMTQSPSSLSASLGGKVTITCKASQDIKKYIG
WYQHKPGKGPRLLIYYTSTLQPGIPSRFSGSGSGRDYSLSIRNLEPEDIATYYCQQY
DNLPLTFGSGTKLEIKRGGGGSGGGGSGGGGSDVQLQESGPGLVKPSQSLSLTCSV
TGYSITSGFYWNWIRQFPGNKLEWMGHISHDGRNNYNPSLINRISITRDTSKNQFFL
KLSSVTTEDTATYFCARHYGSSGAMDYWGQGTSVTVSSD 40.2.220-hmtIgG1-hCD80 (nucleotide sequence) (SEQ ID NO: 49)
aagcttatggatttttcaagtgcagattttcagcttcctgctaatcagtgcttcagtcataatgtccagaggagtcgacattgttctgactc
agtctccagccaccctgtctgtgactccaggagatagagtctctctttcctgcagggccagccagagtattagcgactacttacactg
gtatcaacaaaaatcacatgagtctccaaggcttctcatcaaatatgcttcccattccacctctgggatcccctccaggttcagtggca
gtggatcagggtcagatttcactctcagtatcaacagtgtggaacctgaagatgttggaatttattactgtcaacatggtcacagctttc
cgtggacgttcggtggaggcaccaagctggaaatcaaacgggggtggcggttcgggtggcggtggatctggtggcggcggcg
gatctcagatccagttggtgcaatctggacctgagctgaagaagcctggagagacagtcaggatctcctgcaaggcttctgggtat
gccttcacaactactgaatgcagtgggtgcaagagatgccaggaaagggtttgaagtggattggctggataaacacccactctg
gagtgccaaaatatgtagaagacttcaaggacggtttgccttctcttggaaacctctgccaacactgcatatttacagataagcaacc
tcaaagatgaggacacggctacgtatttctgtgtgagatccgggaatggtaactatgacctggcctactttgcttactggggccaag
ggacactggtcactgtctctgatctggagcccaaatcttctgacaaaaactcacacatccccaccgtcccagcacctgaactcctgg
gggatcgtcagtcttcctcttcccccaaaaccaaggacaccctcatgatctcccggacccctgaggtcacatgcgtggtggtg
gacgtgagccacgaagaccctgaggtcaagttcaactggtacgtggacggcgtggaggtgcataatgccaagacaaagccgcg
ggaggagcagtacaacagcacgtaccgtgtggtcagcgtcctcaccgtcctgcaccaggactggctgaatggcaaggagtacaa
gtgcaaggtctccaacaaagccctcccagcccccatcgagaaaaccatctccaaagccaaagggcagccccgagaaccacagg
tgtacaccctgcccccatcccgggatgagctgaccaagaaccaggtcagcctgacctgcctggtcaaaggcttctatcccagcga
catcgccgtggagtgggagagcaatgggcagccggagaacaactacaagaccacgcctcccgtgctggactccgacggctcct
tcttcctctacagcaagctcaccgtggacaagagcaggtggcagcaggggaacgtcttctcatgctccgtgatgcatgaggctctg
cacaaccactacacgcagaagagcctctccctgtctccgggtaaagcggatccttcgaacctgctcccatcctgggccattacctta
atctcagtaaatggaattttttgtgatatgctgcctgacctactgctttgccccaagatgcagagagagaaggaggaatgagagattga
gaagggaaagtgtacgccctgtataaatcgat 40.2.220-hmtIgG1-hCD80 (amino acid sequence) (SEQ ID NO: 50)
MDFQVQIFSFLLISASVIMSRGVDIVLTQSPATLSVTPGDRVSLSCRASQSISDYLHW
YQQKSHESPRLLIKYASHSISGIPSRFSGSGSGSDFTLSINSVEPEDVGIYYCQHGHSF
PWTFGGGTKLEIKRGGGSGGGGSGGGGSQIQLVQSGPELKKPGETVRISCKASG
YAFTTTGMQWVQEMPGKGLKWIGWINTPLWSAKICRRLQGRFAFSLETSANTAY -continued LQISNLKDEDTATYFCVRSGNGNYDLAYFAYWGQGTLVTVSDLEPKSSDKTHTSP
PSPAPELLGGSSVFLFPPKPKDTLMISRTPEVTCVVVDVSHEDPEVKFNWYVDGVE
VHNAKTKPREEQYNSTYRVVSVLTVLHQDWLNGKEYKCKVSNKALOAOIEKTISK
AKGQPREPQVYTLPPSRDELTKNQVSLTCLVKGFYPSDIAVEWESNGQPENNYKT
TPPVLDSDGSFFLYSKLTVDKSRWQQGNVFSCSVMHEALHNHYTQKSLSLSPGKA
DPSNLLPSWAITLISVNGIFVICCLTYCFAPRCRERRRNERLRRESVRPV 2e12scFv-hmtIgG1-CD80 fusion protein (nucleotide sequence) (SEQ ID NO: 51)
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcgggcggaggtggg
tcgggtggcggcggatctcaggtgcagctgaaggagtcaggacctggcctggtggcgcccgcacagagcctgtccatcacatgc
accgtctcagggttctcattaaccggctatggtgtaaactgggttcgccagcctccaggaaagggtctggagtggctgggaatgat
atggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacacatccccaccgtcccca
gcacctgaactcctgggggggatcgtcagtcttcctcttccccccaaaacccaaggacaccctcatgatctcccggacccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagccctcccagcccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaagcggatccttcgaacctgctccc
atcctgggccattaccttaatctcagtaaatggaatttttgtgatatgctgcctgacctactgctttgccccaagatgcagagagagagagaa
ggaggaatgagagattgagaagggaaagtgtacgccctgtataaatcgat 2e12scIFv-hmtIgG1-CD80 fusion protein (amino acid sequence) (SEQ ID NO: 52)
MDFQVQIFSFLLISASVIMSRGVDIVLTQSPASLAVSLGQRATISCRASESVEYYVTS
LMQWYQQKPGQOOKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKEN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWWSNGQ
PENNYKTTPPVLDSDGSFFLYSKLTVDKSRWQQGNVFSCSVMHEALHNHYTQKSL
SLSPGKADPSNLLPSWAITLISVNGIFVICCLTYVFAPRCRERRRNERLRRESVRPV 10A8 scFv-hmtIgG1-CD80 (nucleotide sequence) (SEQ ID NO: 53)
aagcttatggattttcaagtgcagattttcagcttcctgctaatcagtgcttcagtcataatgtccagaggagtcgacatccagatgaca
cagtctccatcctcactgtctgcatctctgggaggcaaagtcaccatcacttgcaaggcaagccaagacattaagaagtatataggtt
ggtaccaacacaagcctggaaaaggtcccaggctgctcatatattacacatctacattacagccaggcatcccatcaaggttcagtg
gaagtgggtctgggagagattattccctcagcatcagaaacctggagcctgaagatattgcaacttattattgtcaacagtatgataat
cttccattgacgttcggctcggggacaaagttggaaataaaacggggtggcggtggctcgggcggtggtgggtcgggtggcgggc
ggatctgatgtacagcttcaggagtcaggacctggcctcgtgaaaccttctcagtctctgtctctcacctgctctgtcactggctactc
catcaccagtggtttctactggaactggatccgacagtttccgggaaacaaactggaatggatgggccacataagccacgacggta
ggaataactacaacccatctctcataaatcgaatctccatcactcgtgacacatctaagaaccagtttttcctgaagttgagttctgtga
ctactgaggacacagctacatatttctgtgcaagacactacggtagtagcggagctatggactactggggtcaaggaacctcagtc
accgtctcctctgatctggagcccaaatcttctgacaaaactcacacatccccaccgtccccagcacctgaactcctgggggatc
gtcagtcttcctcttccccccaaaacccaaggacaccctcatgatctcccggacccctgaggtcacatgcgtggtggtggacgtga
gccacgaagaccctgaggtcaagttcaactggtacgtggacggcgtggaggtgcataatgccaagacaaagccgcgggagga
gcagtacaacagcacgtaccgtgtggtcagcgtcctcaccgtcctgcaccaggactggctgaatggcaaggagtacaagtgcaa
ggtctccaacaaagccctcccagcccccatcgagaaaaccatctccaaagccaaagggcagccccgagaaccacaggtgtaca
ccctgcccccatcccgggatgagctgaccaagaaccaggtcagcctgacctgcctggtcaaaggcttctatcccagcgacatcgc
cgtggagtgggagagcaatgggcagccggagaacaactacaagaccacgcctcccgtgctggactccgacggctccttcttcct
ctaccagcaagctcaccgtggacaagagcaggtggcagcaggggaacgtcttctcatgctccgtgatgcatgaggctctgcacaac
cactacacgcagaagagcctctccctgtctccgggtaaagcggatccttcgaacctgctcccatcctgggccattaccttaatctca
gtaaatggaatttttgtgatatgctgcctgacctactgctttgccccaagatgcagagagagaaggaggaatgagagattgagaagg
gaaagtgtacgccctgtataaatcgat 10A8 scFv-hmtIgG1-CD80 (amino acid sequence) (SEQ ID NO: 54)
MDFQVQIFSFLLISASVIMSRGVDIQMTQSPSSLSASLGGKVTITCKASQDIKKYIG
WYQHKPGKGPRLLIYYTSTLQPGIPSRFSGSGSGRDYSLSIRNLEPEDIATYYCQQY
DNLPLTFGSGTKLEIKRGGGGSGGGGSGGGGSDVQLQESGPGLVKPSQSLSLTCSV
TGYSITSGFYWNWIRQFPGNKLEWMGHISHDGRNNYNPSLINRISITRDTSKNQFFL
KLSSVTTEDTATYFCARHYGSSGAMDYWGQGTSVTVSSDLEPKSSDKTHTSPPSP
APELLGGSSVFLFPPKPKDDTLMISRTPEVTCVVVDVSHEDPEVKFNWYVDGVEVH
NAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALNHYTQKSLSLSPGKADPS
NLLPSWAITLISVNGIFVICCLTYCFAPRCRERRRNERLRRESVRPV 500A2-hmtIgG1-CD80 (nucleotide sequence) (SEQ ID NO: 55)
atgttgtatacatctcagctccttgggcttttactcttctggatttcagcctccagaagtgacatagtgctgactcagactccagccactc
tgtctctaattcctggagaaagagtcacaatgacctgtaagaccagtcagaatattggcacaatcttacactggtatcaccaaaaacc
aaaggaggctccaagggctctcatcaagtatgcttcgcagtccattcctgggatcccctccagattcagtggcagtggttcggaaac
agatttcactctcagcatcaataacctggagcctgatgatatcggaatttattactgtcaacaaagtagaagctggcctgtcacgttcg -continued gtcctggcaccaagctggagataaaacggggtggcggtggctcggcggaggtgggtcgggtggcggcggatctcaggtcaa
gctgcagcagtccggttctgaactagggaaacctggggcctcagtgaaactgtcctgcaagacttcaggctacatattcacagatc
actatatttcttgggtgaaacagaagcctggagaagcctgcagtggataggaaatgtttatggtggaaatggtggtacaagctaca
atcaaaaattccagggcaaggccacactgactgtagataaaatctctagcacagcctacatggaactcagcagcctgacatctgag
gattctgccatctattactgtgcaagaaggccggtagcgacgggcatgcatggactactgggtcaggggatccaagttaccgt
ctcctctgatctggagcccaaaatcttctgacaaaactcacacatccccaccgtcccagcacctgaactcctgggggatcgtcagt
cttcctcttcccccaaaacccaaggacaccctcatgatctcccggacccctgaggtcacatgcgtggtggtggacgtgagccacg
aagaccctgaggtcaagttcaactggtacgtggacggcgtggaggtgcataatgccaagacaaagccgcgggaggagcagtac
aacagcacgtaccgtgtggtcagcgtcctcaccgtcctgcaccaggactggctgaatggcaaggagtacaagtgcaaggtctcca
acaaagtccctcccagcccccatcgagaaaaccatctccaaagccaaagggcagccccgagaaccacaggtgtacaccctgccc
ccatcccgggatgagctgaccaagaaccaggtcagcctgacctgcctggtcaaaggcttctatcccagcgacatcgccgtggagt
gggagagcaatgggcagccggagaacaactacaagaccacgcctcccgtgctggactccgacggctccttcttcctctacagca
agctcaccgtggacaagagcaggtggcagcaggggaacgtcttctcatgctccgtgatgcatgaggctctgcacaaccactacac
gcagaagagcctctccctgtctccgggtaaaacggatccttcgaacctgctcccatcctgggccattaccttaatctcagtaaatgga
atttttgtgatatgctgcctgacctactgctttgccccaagatgcagagagagaaggaggaatgagagattgagaaggggaaagtgta
cgccctgtataaatcgat 500A2-hmtIgG1-CD80 (amino acid sequence) (SEQ ID NO: 56)
MLYTSQLLGLLLFWISASRSDIVLTQTPATLSLIPGERVTMTCKTSQNIGTILHWYH
QKPKEAPRALIKYASQSIPGIPSRFSGSGSETDFTLSINNLEPDDIGIYYCQQSRSWPV
TFGPGTKLEIKRGGGGSGGGGSGGGGSQVKLQQSGSELGKPGASVKLSCKTSGYIF
TDHYISWVKQKPGESLQWIGNVYGGNGGTSYNQKFQGKATLTVDKISSSTAYMEL
SSLTSEDSAIYYCARRPVATGHAMDYWGQGVTVSSDLEPKSSDKTHTSPPSPAP
ELLGGSSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQ
PREPQVTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGKADPSNL
LPSWAITLISVNGIFVICCLTYCFAPRCRERRRNERLRRESVRPV 2H7 scFv MTH(SSS)WTCH2CH3 (nucleotide sequence) (SEQ ID NO: 57)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgtcgctcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctggaggaggtg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccctcccagccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagacctctccctgtctccgggtaaatgatctaga 2H7 scFv MTH(SSS)WTCH2CH3 (amino acid sequence) (SEQ ID NO: 58)
MDFQVQIFSFLLISASVIIARGQIVLSQSPAILSASPGEKVTMTCRASSSCSYMHWY
QQKPGSSPKPWIYAPSNLASGVPARFSGSGSGTSTSLTISRVEAEDAATYYCQQWS
FNPPTFGAGTKLELKDGGGSGGGGSGGGGSSQAYKQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 2H7 scFv IgAH IGG WT CH2CH3 (2H7 scFv with IgA hinge and WT CH2 and CH3)
(nucleotide sequence) (SEQ ID NO: 59)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctggaggaggttg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctctgatcagccagttcccaactccacctaccccatctcctcaactccacctaccccatctccctca
tgcgcacctgaactcctgggggaccgtcagtcttcctcttccccccaaaacccaaggacaccctcatgatctcccggacccctga
ggtcacatgcgtggtggtggacgtgagccacgaagaccctgaggtcaagttcaactggtacgtggacggcgtggaggtgcataa
tgccaagacaaagccgcgggaggagcagtacaacagcacgtaccgtgtggtcagcgtcctcaccgtcctgcaccaggactggc
tgaatggcaaggagtacaagtgcaaggtctccaacaaagcccctcccagccccatcgagaaaacaatctccaaagccaaagggc
agccccgagaaccacaggtgtacaccctgcccccatcccgggatgagctgaccaagaaccaggtcagcctgacctgcctggtca
aaggcttctatcccagcgacatcgccgtggagtgggagagcaatgggcagccggagaacaactacaagaccacgcctcccgtg -continued ctggactccgacggctccttcttcctctacagcaagctcacctgtggacaagagcaggtggcagcaggggaacgtcttctcatgctc
cgtgatgcatgaggctctgcacaaccactacacgcagaagagcctctccctgtctccgggtaaatgatctaga 2H7 scFv 1gAH IGG WT CH2CH3 (amino acid sequence) (SEQ ID NO: 60)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSDQPVPSTPPTP
SPSTPPTPSPSCAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIELTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGK 2H7 scFv IgAH IgACH2CH3 (2H7 scFv IgAhinge and IgA CH2 and CH3) (nucleotide
sequence) (SEQ ID NO: 61)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctccccaaaccctggatttatgcccatccaacctggcttctggagtcccatctcgcttcagtg
gcagtgggtctgggacctcttactctctcacaatcagcagagtggaggctgaagatgctgccacttattactgccagcagtggagttt
taacccacccacgttcggtgctgggaccaagctggagctgaaagatggcggtggctcgggcggtggtggatctggaggaggttca
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggttactatagtaactcttactggtacttcgatgtctggggcac
agggaccacggtcaccgtctcttctgatcagccagttccctcaactccacctaccccatctccctcaactccacctaccccatctccc
tcatgctgccaccccgactgtcactgcaccgaccggccctcgaggacctgctcttaggttcagaagcgatcctcacgtgcacact
gaccggcctgagagatgcctcaggtgtcaccttcacctggacgccctcaagtgggaagagcgctgttcaaggaccacctgaccgt
gacctctgtggctgctacagcgtgtccagtgtcctgccgggctgtgccgagccatgggaagaccttcacttgcactgc
tgcctaccccgagtccaagaccccgctaaccgccaccctctcaaaatccggaaacacattccggcccgaggtccacctgctgccg
ccgccgtcggagagctggccctgaacgagctggtgacgctgacgtgcctggcacgtggcttcagccccaaggatgtgctggtt
cgatggctgcaggggtcacaggagctgccccgcgagaagtacctgacttgggcatcccggcaggagcccagccagggcacca
ccaccttcgctgtgaccagcatactgcgcgttggcagccgaggactggaagaaggggacaccttctcctgcatggtgggccacg
aggcccctgccgctggccttcacacagaagaccatcgaccgcttggcgggtaaacccacccatgtcaatgtgtctgttgtcatggcg
gaggtggacggcacctgctactgataatctaga 2H7 scFv IgAH IgACH2CH3 (2H7 scFv IgA hinge and IgA CH2 and CH3) (amino
acid sequence) (SEQ ID NO: 62)
MDFQVQIFSFLLISASVIIARGQWLSQSPAILSASPGEKVTMTCRASSSVSYMHWY
QQKPGSSPKIPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQPVPSTPPT
PSPSTPPTPSPSCCHPRLSLHRPALEDLLLGSEAILTCLTGLRDASGVTFTWTPSSG
KSAVQGPPDRDLCGCYSVSSVLPGCAEPWNHGKTFTCTAAYPESKTPLTATLSKS
GNTFRPEVHLLPPPSEELALNBLVTLTCLARGFSPKDVLVRWLQGSQELPREKYLT
WASRQEPSQGTTTFAVTSRRVAAEDWKKGDTFSCMVGHEALPLAFTQKTIDRLA
GKPTHVNVSVVMAEVDCTCY IgA hinge-CH2-CH3 (Human IgA tail, full length) (nucleotide sequence) (SEQ ID NO: 63)
tgatcagccagttccctcaactccacctaccccatctccctcaactccacctaccccatctccctcatgctgccaccccgactgtca
ctgcaccgaccggccctcgaggacctgctcttaggttcagaagcgatcctcacgtgcacactgaccggcctgagagatgcctcag
gtgtcaccttcacctggacgccctcaagtgggaagagcgctgttcaaggaccacctgaccgtgacctctgtggctgctacagcgtg
tccagtgtcctgccgggctgtgccgagccatggaaccatgggaaccttcacttgcactgcctacccccgagtccaagaccc
cgctaaccgccaccctctcaaaatccggaaacacattccggcccgaggtccacctgctgccgccgccgtcggaggagctggccc
tgaacgagctggtgacgctgacgtgcctggcacgtggcttcagccccaaggatgtgctggttcgctggctgcaggggtcacagg
agctgccccgcgagaagtacctgacttgggcatcccggcaggagcccagccagggcaccaccaccttcgctgtgaccagcata
ctgcgcgtggcagccgaggactggaagaaggggacaccttctcctgcatggtgggccacgaggcccctgccgctggccttcac
acagaagaccatcgaccgcttggcgggtaaacccacccatgtcaatgtgtctgttgtcatggcggaggtggacggcacctgctact
gataatctaga IgA hinge-CH2-CH3 (Human IgA tail, full length) (amino acid sequence) (SEQ ID NO: 64)
DQPVPSTPPTPSPSTPPTPSPSCCHPRLSLHZRPALEDLLLGSEAILTCLTGLRDASGV
TFTWTPSSGKISAVQGPPDRDLCGCYSVSSVLPGCAEPWNHGKTFTCTAAYPESKT
PLTATLSKSGNTFRPEVHLLPPPSEELALNBLVTLTCLARGFSPKDVLVRWLQGSQ
ELPREKYLTWASRQEPSQGTTTFAVTSILRVAAEDWKKGDTFSCMVGHEALPLAF
TQKTIDRLAGKPTHVNVSVVMAEVDGTCY Human J Chain (nucleotide sequence) (SEQ ID NO: 65)
agatctcaagaagatgaaggatgttcttgttgacaaacaaatgtaagtgtgcccggattacttccaggatcatccgttcttccgaaga
tcctaatgaggacattgtggagagaaacatccgaattattgttcctctgaacaacagggagaatatctctgatcccacctccaccattga
gaaccagatttgtgtaccatttgtctgacctcagctgtaaaaaatgtgatcctacagaagtggagctggataatcagatagttactgct
acccagagcaatatctgtgatgaagacagtgctacagagacctgctacacttatgacagaaacaagtgctacacagctgtggtccc
actcgtatatggtggtgagaccaaaatggtggaaacagccttaaccccagatgcctgctatcctgactaatctaga Human J Chain (amino acid sequence) (SEQ ID NO: 66)
RSQEDERIVLVDNKCKCARITSRIIRSSEDPNEDIVERNIRIVPLNNRENISDPTSPLR
TRFVYHLSDLSCKKCDPTEVELDNQIVTATQSNICDEDSATETCYTYDRNKCYTAV
VPLVYGGETKMVETALTPDACYP -continued 4 carboxy terminal amino acids deleted from IgA CH3 (amino acid sequence) (SEQ ID NO: 67)
GTCY IgAH IgAT4 (human IgA tail, truncated (3T1)-(missing last 4 amino acids from carboxy
terminus) (nucleotide sequence) (SEQ ID NO: 68)
tgatcagccagttccctcaactccacctaccccatctccctcaactccacctaccccatctccctcatgctgccaccccgactgtca
ctgcagccagttccctcaactccacctaccccatctccctcaactccacctaccccatctccctcatgctgccaccccgactgtca
gtgtcacctcacctggacgccctcaagtgggaagagcgctgttcaaggaccacctgaccgtgacctctgtggctgctacagcgtg
tccagtgtcctgccgggctgtgccgagccatggaaccatgggaagaccttcacttgcactgctgcctaccccgagtccaagaccc
cgctaaccgccaccctctcaaaatccggaaacacattccggcccgaggtccacctgctgccgccgccgtcggaggagctggccc
tgaacgagctggtgacgctgacgtgcctggcacgtggcttcagccccaaggatgtgctggttcgctggctgcagggtcacagg
agctgccccgcgagaagtacctgacttgggcatcccggcaggagcccagccagggcaccaccaccttcgctgtgaccagcata
ctgcgcgtggcagccgaggactggaagaaggggggacaccttcctgcatggtgggccacgaggccctgccgctggccttcac
acagaagaccatcgaccgcttggcgggtaaacccacccatgtcaatgtgtctgttgtcatggcggaggtggactgataatctaga IgAH IgAT4 (amino acid sequence) (SEQ ID NO: 69)
DQPVPSTPPTPSPSTPPTPSPSCCHPRLSLHRPALEDLLLGSEAILTCTLTCTLTGLRDASGV
TFTWTPSSGKSAVQGPPDRDLCGCYSVSSVLPGCAEPWNHGKTFTCTAAYPESKT
PLTATLSKSGNTFRPEVHLLPPPSEELALNELVTLTCLARGFSPKDVLVRWLQGSQ
ELPREKYLTWASRQEPSQGTTTFAVTSILRVAAEDWKKGDTFSCMVGHEALPLAF
TQKTIDRLAGKPTHVNVSVVMAEVD 2H7 scFv IgAH IgAT4 (2H7 scFv IgA 3T1 construct; truncates the CH3 domain at
the 3'end) (nucleotide sequence) (SEQ ID NO: 70)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggcaagctcaagtgtaagttacatgcact
ggtaccagcagaagccaggatcctcccccaaaccctggatttatgccccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtgatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagggtggtgtactatagtaactcttactggtacttcgatgtctggggcac
agggaccacggtcaccgtctcttctgatcagccagttccctcaactccacctaccccatctccctcaactccacctaccccatctccc
tcatgctgccaccccgactgtcactgcaccgaccggccctcgaggacctgctcttaggttcagaagcgatcctcacgtgcacact
gaccggcctgagagatgcctcaggtgtcaccttcacctggacgccctcaagtgggaagagcgctgttcaaggaccacctgaccgt
gacctctgtggctgctacagcgtgtccagtgtcctgccgggctgtgccgagccatggaaccatgggaagaccttcacttgcactgc
tgcctaccccgagtccaagaccccgctaaccgccaccctctcaaaatccggaaacacattccggcccgaggtccacctgctgccg
ccgccgtcggaggagctggccctgaacgagctggtgacgctgacgtgcctggcacgtggcttcagccccaaggatgtgctggtt
cgctggctgcagggtcacaggagctgccccgcgagaagtacctgacttgggcatcccggcaggagcccagccagggcacca
ccaccttcgctgtgaccagcatactgcgcgtggcagccgaggactggaagaaggggggacaccttcctgcatggtgggccacg
aggccctgccgctggccttcacacagaagaccatcgaccgcttggcgggtaaacccacccatgtcaatgtgtgctgttgtcatggcg
gaggtggactgataatctaga 2H7 scFv IgAH-T4 (amino acid sequence) (SEQ ID NO: 71)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQPVPSTPPT
PSPSTPPTPSPSCCHPRLSLHRPALEDLLLGSEAILTCTLTGLRDASGVTFTWTPSSG
KSAVQGPPDRDLCGCYSVSSVLPGCAEPWNHGKTFTCTAAYPESKTPLTATLSKS
GNTFRPEVHLLPPPSEELALNELVTLTCLARGFSPKDVLVRWLQGSQELPREKYLT
WASRQEPSQGTTTFAVTSILRVAAEDWKKGDTFSCMVGHEALPLAFTQKTIDRLA
GKPTHVNVSVVMAEVD 14 amino acids deleted from IgAH-T4 (so that total of 18 amino acids deleted from
wild type IgA CH3) (amino acid sequence) (SEQ ID NO: 72)
PTHVNVSVVMAEVD IgAH IgA-T18 (human IgA Tail truncated, 3T2) (nucleotide sequence) (SEQ ID NO: 73)
tgatcagccagttccctcaactccacctaccccatctccctcaactccacctaccccatctccctcatgctgccaccccgactgtca
ctgcaccgaccggccctcgaggacctgctcttaggttcagaagcgatcctcacgtgcacactgaccggcctgagagatgccag
gtgtcaccttcacctggacgccctcaagtgggaagagcgctgttcaaggaccacctgaccgtgacctctgtggctgctacagcgtg
tccagtgtcctgccgggctgtgccgagccatggaaccatgggaagaccttcacttgcactgctgcctaccccgagtccaagaccc
cgctaaccgccaccctctcaaaatccggaaacacattccggcccgaggtccacctgctgccgccgccgtcggaggagctggccc
tgaacgagctggtgacgctgacgtgcctggcacgtggcttcagccccaaggatgtgctggttcgctggctgcagggtcacagg
agctgccccgcgagaagtacctgacttgggcatcccggcaggagcccagccagggcaccaccaccttcgctgtgaccagcata
ctgcgcgtggcagccgaggactggaagaaggggggacaccttcctgcatggtgggccacgaggccctgccgctggccttcac
acagaagaccatcgaccgcttggcgggtaaa IgAH IgA-T18 (amino acid sequence) (SEQ ID NO: 74)
DQPVPSTPPTPSPSTPPTPSPSCCHPRLSLHRPALEDLLLGSEAILTCTLTGLRDASGV
TFTWTPSSGKSAVQGPPDRDLCGCYSVSSVLPGCAEPWNHGKTFTCTAAYPESKT
PLTATLSKSGNTFRPEVHLLPPPSEELALNELVTLTCLARGFSPKDVLVRWLQGSQ
ELPREKYLTWASRQEPSQGTTTFAVTSILRVAAEDWKKGDTFSCMVGHEALPLAF
TQKTIDRLAGK -continued 2H7 scFv IgAH IgAT18 (human IgA Tail truncated, 3T2) (nucleotide sequence) (SEQ ID NO: 75)
aagcttgccgccatggattttcaagtgcagattttcagcttcctgctaatcagtgcttcagtcataattgccagaggacaaattgttctct
cccagtctccagcaatcctgtctgcaactccaggggagaaggtcacaatgacttgcagggccagctcaagtgtaagttacatgcact
ggtaccagcagaagccaggatcctccccccaaaccctggatttatgcccatccaacctccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggccggtggtggatctgaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgcgctatttctgtgcaagagtggtgtactatagtaactcttactggtacttcgatgtctggggcac
agggaccacggtcaccgtctcttctgatcagccagttccctcaactccacctacccctcccctcaactccacctaccccatctccc
tcatgctgccaccccgactgtcactgcaccgacccgcctcgaggacctgctcttaggttcagaagcgatcctcacgtgcacact
gaccggcctgagagatgcctcaggtgtcaccttcacctggacgcccctcaagtgggaagagcgctgttcaaggcacacctgaccgt
gacctctgtggctgctacagcgtgtccagtgtcctgccgggctgtgccgagccatggaaccatgggaagaccttcacttgcactgc
tgcctaccccgagtccaagaccccgctaaccgccaccctctcaaaatccggaaacacattccggcccgaggtccacctgctgccg
ccgccgtcggaggagctggccctgaacgagctggtgacgctgacgtgcctggcacgtggcttcagccccaaggatgtgctggtt
cgctggctgcagggggtccaggaggctgccccgcgagaagtacctgacttgggcatccggcaggagcccagccagggcacca
ccaccttcgctgtgaccagcatactgcgcgtggcagcgaggactggaagaaggggggacaccttctcctgcatggtgggccacg
aggccctgccgctggccttcacacagaagaccatcgaccgcttggcgggtaaa 2H7 scFv IgAH IgAT18 (amino acid sequence) (SEQ ID NO: 76)
MDFQVQIFSFLLISASVILARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQPVPSTPPT
PSPSTPPTPSPSCCHPRLSLHRPALEDLLLGSEAILTCLTLGRDASGVTFTWTPSSG
KSAVQGPPDRDLCGCYSVSSVLPGCAEPWNHGKTFTCTAAYPESKTPLTATLSKS
GNTFRPEVHLLPPSEELALNELVTLTCLARGFSPKDVLVRWLQGSQELPREKYLT
WASRQEPSQGTTTFAVTSILRVAAEDWKKGDTFSCMVGHEALPLAFTQKTIDRLA
GK CTLA-4 IgG WTH WTCH2CH3 (human-oncoMLP-CTLA4EC-hIgGWT)
(nucleotide sequence) (SEQ ID NO: 77)
gcaacctacatgatggggaatgagttgaccttcctagatgattccatctgcacgggcacctccagtggaaatcaagtgaacctcact
atccaaggactgagggccatggacacgggactctacatctgcaaggtggagctcatgtacccaccgccatactacctgggacatag
gcaacggaacccagatttatgtaattgatccagaaccgtgcccagattctgatcaaactcttgtgacaaaactcacacatgcc
caccgtgcccagcacctgaactcctgggggaccgtcagtcttcctcttccccccaaaacccaaggacaccctcatgatctcccgg
acccctgaggtcacatgcgtggtggtggacgtgagccacgaagaccctgaggtcaagttcaactggtacgtggacggcgtggag
gtgcataatgccaagacaaagccgcgggaggagcagtacaacagcacgtaccgtgtggtcagcgtcctcaccgtcctgcaccag
gactggctgaatggcaaggagtacaagtgcaaggtctccaacaaagccctcccagcccccatcgagaaaaccatctccaaagcc
aaagggcagccccgagaaccacaggtgtacaccctgcccccatcccgggatgagctgaccaagaaccaggtcagcctgacctg
cctggtcaaaggcttctatcccagcgacatcgccgtggagtgggagagcaatgggcagccggagaacaactacaagaccacgc
ctcccgtgctggactccgacggctccttcttcctctacagcaagctcaccgtggacaagagcaggtggcagcaggggaacgtctt
ctcatgctccgtgatgcatgaggctctgcacaaccactacacgcagaagagcctctccctgtctccgggtaaatga CTLA-4 IgG WTH WTCH2CH3 (amino acid sequence) (SEQ ID NO: 78)
MGVLLTQRTLLSLVLALLFPSMASMAMHVAQPAVVLASSRGIASFVCEYASPGKA
TEVRVTVLRQADSQVTEVCAATYMMGNELTFLDDSICTGTSSGNQVNLTIQGLRA
MDTGLYICKVELMYPPPYYLGIGNGTQIYVIDPEPCPDQPKSCDKTHTCPPCPAP
ELLGGPSVFLFPPKPKDTLMISRTPEVTCVVVDVSHEDPEVKFNWYVDGVEHNA
KTKPREEQYNSTVRVVSVLTVLHQDWLNGKEYKCKVSNKALPAPIEKTISKAKGQ
PREPQVYTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGK Human OncoM leader Peptide + CTLA4 EC (BclI) (nucleotide sequence) (SEQ ID NO: 79)
atgggggtactgctcacacagaggacgctgctcagtctggtccttgcactcctgtttccaagcatggcgcagcatggcaatgcacgt
ggcccagcctgctgtggtactggccagcagccgaggcatcgccagctttgtgtgtgagtatgcatctccaggcaaagccactgag
gtccgggtgacagtgcttcggcaggctgacagccaggtgactgaagtctgtgcggcaacctacatgatggggaatgagttgacct
tcctagatgattccatctgcacgggcacctccagtggaaatcaagtgaacctcactatccaaggactgagggccatggacacggg
actctacatctgcaaggtggagctcatgaaccccaccgccatactacctgggacataggcaacggaacccagatttatgtaattgatcc
agaaccgtgcccagattctgatcaa Human OncoM leader Peptide + CTLA4 EC (amino acid sequence) (SEQ ID NO: 80)
MGVLLTQRTLLSLVLALLFPSMASMAMHVAQPAVVLASSRGIASFVCEYASPGKA
TEVRVTVLRQADSQVTEVCAATYMMGNELTFLDDSICTGTSSGNQVNLTIQGLRA
MDTGLYICKVELMYPPPYYLGIGNGTQIYVIDPEPCPDSQ Human OncoM leader (nucleotide sequence) (SEQ ID NO: 81)
atgggggtactgctcacacagaggacgctgctcagtctggtccttgcactcctgtttccaagcatggcgagcat Human OncoM leader (amino acid sequence) (SEQ ID NO: 82)
MGVLLTQRTLLSLVLALLFPSM Human CTLA4 EC (no LP) (nucleotide sequence) (SEQ ID NO: 83)
gcaatgcacgtggcccagcctgctgtggtactggccagcagccgaggcatcgccagctttgtgtgtgagtatgcatctccaggca
aagccactgaggtccgggtgacagtgcttcggcaggctgacagccaggtgactgaagtcgtgcggcaacctacatgacgggga
atgagttgaccttcctagatgattccatctgcacgggcacctccagtggaaatcaagtgaacctcactatccaaggactgagggcca -continued tggacacgggactctacatctgcaaggtggagctcatgtacccaccgccatactacctgggcataggcaacggaacccagatttat
gtaattgatccagaaccgtgcccagattct Human CTLA4 EC (no LP) (amino acid sequence) (SEQ ID NO: 84)
AMHVAQPAVVLASSRGLASFVCEYASPGKATEVRVTVLRQADSQVTEVCAATYM
TGNELTFLDDSICTGTSSGNQVNLTIQGLRAMDTGLYICKVELMYPPPYYLGIGNG
TQIYVIDPEPCPDS Human CTLA4 IgG MTH (SSS) MTCH2CH3 (nucleotide sequence) (SEQ ID NO: 85)
atggggtactgctcacacagaggacgctgctcagtctggtccttgcactcctgtttccaagcatggcgagcatggcaatgcacgt
ggcccagcctgctgtggtactggccagcagccgaggcatcgccagctttgtgtgtgagtatgcatctccaggcaaagccactgag
gtccgggtgacagtgcttcggcaggctgacagccaggtgactgaagtctgtgcggcaacctacatgatggggaatgagttgacct
tcctagatgattccatctgcacgggcacctccagtggaaatcaagtgaacctgactatccaaggactgagggccatggacacggg
actctacatctgcaaggtggagctcatgtacccaccgccatactacctgggcataggcaacggaacccagatttatgtaattgatcc
agaaccgtgcccagattctgatcaacccaaatcttctgacaaaactcacacatccccaccgtccccagcacctgaactcctggggg
gatcgtcagtcttcctcttccccccaaaacccaaggacaccctcatgatctcccggacccctgaggtcacatgcgtggtggtggac
gtgagccacgaagaccctgaggtcaagttcaactggtacgtggacggcgtggaggtgcataatgccaagacaaagccgcggga
ggagcagtacaacagcacgtaccgtgtggtcagcgtcctcaccgtcctgcaccaggactggctgaatggcaaggagtacaagtg
caaggtctccaacaaagccctcccagcccccatcgagaaaacaatctccaaagccaaagggcagccccgagaaccacaggtgt
acaccctgcccccatcccgggatgagctgaccaagaaccaggtcagcctgacctgcctggtcaaaggcttctatcccagcgacat
cgccgtggagtgggagagcaatgggcagccggagaacaactacaagaccacgcctcccgtgctggactccgacggctccttctt
cctctacagcaagctcaccgtggacaagagcaggtggcagcaggggaacgtcttctcatgctccgtgatgcatgaggctctgcac
aaccactacacgcagaagagcctctccctgtctccgggtaaatga Human CTLA4 IgG MTH (SSS) MTCH2CH3 (amino acid sequence) (SEQ ID NO: 86)
MGVLLTQRTLLSLVLALLFPSMASMAMHVAQPAVVLASSRGLASFVCEYASPGKA
TEVRVTVLRQADSQVTEVCAATYMMGNELTFLDDSICTGTSSGNQVNLTIQGLRA
MDTGLYICKVELMYPPPYYLGIGNGTQIYVIDPEPCPDSDQPKSSDKTHTSPPSPAP
ELLGGSSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQ
PREPQVYTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGK CTLA-4 IgAH IgACH2CH3 (human-oncoMLP-CTLA4EC-IgA) (nucleotide
sequence) (SEQ ID NO: 87)
atggggtactgctcacacagaggacgctgctcagtctggtccttgcactcctgtttccaagcatggcgagcatggcaatgcacgt
ggcccagcctgctgtggtactggccagcagccgaggcatcgccagctttgtgtgtgagtatgcatctccaggcaaagccactgag
gtccgggtgacagtgcttcggcaggctgacagccaggtgactgaagtctgtgcggcaacctacatgatggggaatgagttgacct
tcctagactgattccatctgcacgggcacctccagtggaaatcaagtgaacctcactatccaaggactgagggccatggacacggg
actctacatctgcaaggtggagctcatgtacccaccgccatactacctgggcataggcaacggaacccagatttatgtaattgatcc
agaaccgtgcccagattctgatcagccagttccctcaactccacctaccccatctccctcaactccacctaccccatctccctcatgct
gccaccccgactgtcactgcaccgaccggccctcgaggaccctgctcttaggttcagaagcgatcctcacgtgcacactgaccgg
cctgagagatgcctcaggtgtcaccttcacctggacgccctcaagtgggaagagcgctgttcaaggaccacctgaccgtgacctct
gtggctgctacagcgtgtccagtgtcctgccgggctgtgccgagccatgaaccatgggaagaccttcacttgcactgctgcctac
cccgagtccaagaccccgctaaccgccacccctctcaaaatccggaaacacattcggcccgaggtccacctgctgccgccgcg
tcggaggagctggccctgaacgagctggtgacgctgacgtgcctggcacgtggcttcagcccccaaggatgtgctggttcgctgg
ctgcaggggtcacaggagctgcccgcgaagtacctgacttgggcatcccggcaggagcccagcagggcaccaccacctt
cgctgtgaccagcatactgcgcgtggcagccgaggactgaagaaggggggacaccttctcctgcatggtgggccacgaggccc
tgccgctggccttcacacagaagaccatcgaccgcttggcgggtaaaccacccatgtcaatgtgtctgttgtcatggcggaggtg
gacggcacctgctactgataatctaga CTLA-4 IgAH IgACH2CH3 (amino acid sequence) (SEQ ID NO: 88)
MGVLLTQRTLLSLVLALLFPSMASMAMHVAQPAVVLASSRGIASFVCEYASPGKA
TEVRVTVLRQADSQVTEVCAATYMMGNELTFLDDSICTGTSSGNQVNLTIQGLRA
MDTGLYICKVELMYPPPYYLGIGNGTQIYVIDPEPCPDSDQPVPSTPPTPSPSTPPTP
SPSCCHPRLSLHRPALEDLLLGSEAILTCTLTGLRDASGVTFTWTPSSGKSAVQGPP
DRDLCGCYSVSSVLPGCABPWNHGKTFTCTAAYPESKTPLTATLSKSGNTFRPEVH
LLPPPSEELALNELVTLTCLATGFSPKDVLVRWLQGSQELPREKYLTWASRQEPSQ
GTTTFAVTSILRVAAEDWKKGDTFSCMVGHEALPLAFTQKTIDRLAGKPTHVNVS
VVMACVDGTCY CTLA-4 IgAH IgA-T4 (human-oncoMLP-CTLA4EC-IgA3T1) (nucleotide sequence) (SEQ ID NO: 89)
atggggtactgctcacacagaggacgctgctcagtctggtccttgcactcctgtttccaagcatggcgagcatggcaatgcacgt
ggcccagcctgctgtggtactggccagcagccgaggcatcgccagctttgtgtgtgagtatgcatctccaggcaaagccactgag
gtccgggtgacagtgcttcggcaggctgacagccaggtgactgaagtctgtgcggcaacctacatgatggggaatgagttgacct
tcctagatgattccatctgcacgggcacctccagtggaaatcaagtgaacctcactatccaaggactgagggccatggacacggg
actctacatctgcaaggtggagctcatgtacccaccgccatactacctgggcataggcaacggaacccagatttatgtaattgatcc
agaaccgtgcccagattctgatcagccagttccctcaactccacctaccccatctccctcaactccacctaccccatctccctcatgct
gccaccccgactgtcactgcaccgaccggccctcgaggaccctgctcttaggttcagaagcgatcctcacgtgcacactgaccgg
cctgagagatgcctcaggtgtcaccttcacctggacgccctcaagtgggaagagcgctgttcaaggaccacctgaccgtgacctct
gtggctgctacagcgtgtccagtgtcctgccgggctgtgccgagccatgaaccatgggaagaccttcacttgcactgctgcctac
cccgagtccaagaccccgctaaccgccacccctctcaaaatccggaaacacattcggcccgaggtccacctgctgccgccgcg
tcggaggagctggccctgaacgagctggtgacgctgacgtgcctggcacgtggcttcagcccccaaggatgtgctggttcgctgg
ctgcaggggtcacaggagctgcccgcgaaagtacctgacttgggcatcccggcaggagcccagcaagggcaccaccacctt
cgctgtgaccagcatactgcgcgaggcagccgaggactgaagaaggggggacaccttctcctgcatggtgggccacgaggccc
tgccgctggccttcacacagaagaccatcgaccgcttggcgggtaaaccacccatgtcaatgtgtctgttgtcatggcggaggtg
gactgataatctaga CTLA-4 IgAH IgA-T4 (amino acid sequence) (SEQ ID NO: 90)
MGVLLTQRTLLSLVLALLFPSMASMAMHVAQPAVVLASSRGIASFVCEYASPGKA
TEVRVTVLRQADSQVTEVCAATYMMGNELTFLDDSICTGTSSGNQVNLTIQGLRA
MDTGLYICKVELMYPPPYYLGIGNGTQIYVIDPEPCPDSDQPVPSTPPTPSPSTPPTP
SPSCCHPRLSLHRPALEDLLLGSEAILTCTLTGLRDASGVTFTWTPSSGKSAVQGPP
DRDLCGCYSVSSVLPGCAEPWNHGKTFTCTAAYPESKTPLTATLSKSGNTFRPEVH
LLPPPSEELALNELVTLTCLATGFSPKDVLVRWLQGSQELPRELYLTWASRQEPSQ
GTTTFAVTSILRVAAEDWKKGDTFSCMVGHEALPLAFTQKTIDRLAGKPTHVNVS
VVMAEVD human IgG1 CH2 with 238 mutation pro→ser (nucleotide sequence) (SEQ ID NO: 91)
cctcgaactcctggggggatcgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcggggaggagcagtacaacagcacgtaccgtgtggtcagcgtcctcaccgtcctgcaccaggactggctgaatg
gcaaggagtacaagtgcaaggtctccaacaaagcccctcccagcccccatcgagaaaaccatctccaaagccaaag human IgG1 CH2 with 238 mutation pro→ser (amino acid sequence) (SEQ ID NO: 92)
PELLGGSSVFLPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAK Amino acids surrounding Pro to Ser in CH2 (amino acid sequence) (SEQ ID NO: 93)
PAPELLGGPS Amino acids surrounding Pro to Ser in CH2 (amino acid sequence) (SEQ ID NO: 94)
PAPELLGGSS hIgE3BB (leaves an open reading frame at end of gene to read into transmembrane
and cytoplasmic tail domain attached at either the BamHI or SfuI sites) (nucleotide
sequence) (SEQ ID NO: 95)
gtt gtt ttc gaa gga tcc gct tta ccg gga ttt aca gac acc gct cgc tgg human IgE Fc (CH2-CH3-CH4) ORF (nucleotide sequence) (SEQ ID NO: 96)
tgatcacgtctgctccagggacttcaccccgcccaccgtgaagctcttacagtccgtcctgcgacggcggcgggcacttcccccg
accatccagctcctgtgcctcgtctctgggtacaccccaggactatcaacatcacctggctggaggacgggcaggtcatggacg
tggacttgtccaccgcctctaccacgcaggagggtgagctggcctccacacaaagcgagctcacccctgcagccagaagcactggc
tgtcagaccgcacctacacctgccaggtcacctatcaaggtcacacctttgaggacagcaccaagaagtgtgcagattccaaccc
gagaggggtgagcgcctacctaagccggcccagccccgttcgacctgttcatccgcaagtcgcccacgatcacctgtctggtggtg
gacctggcacccagcaaggggaccgtgaacctgacctggtcccgggccagtgggaagcctgtgaaccactccaccagaaagg
aggagaagcagcgcaatggcacgttaaccgtcacgtccaccctgccggtgggcacccgagactggatcgaggggagacctca
ccagtgcagggtgacccaccccacctgcccaggccctcatgcggtccacgaccaagaccagcggcccgcgtgctgcccg
gaagtctatgcgtttgcgacgccggagtggccgggagcccgggacaagcgcaccctcgcctgcctgatccagaacttcatgcct
gaggacatctcggtgcagtggctgcacaacgaggtgcagctcccggacgcccggcacagacgacgcagccccgcaagacc
aagggctccggcttcttcgtcttcagccgcctggaggtgaccagggccgaatgggagcagaaagatgagttcatctgccgtgcag
tccatgaggcagcgagcccctcacagaccgtccagcgagcggtgtctgtaaatcccggtaaagcggatccttcgaa human IgE Fc (CH2-CH3-CH4) ORF (amino acid sequence) (SEQ ID NO: 97)
DHVCSRDFTPPTVKILQSSCDGGGHFPPTIQLLCLVSGYTPGTINITWLEDGQVMDV
DLSTASTTQEGELASTQSELTLSQKHWLSDRTYTCQVTYQGHTFEDSTLLCADSN
PRGVSAYLSRPSPFDLFIRKSPTITCLVVDLAPSKGTVNLTWSRASGKPVNHSTRKE
EKQRNGTLTVTSTLPVGTRDWIEGETYQCRVTHPHLPRALMRSTTKTSGPRAAPE
VYAFATPEWPGSRDKRTLACLIQNFMPEDISVQWLHNEVQLPDARHSTTQPRKTK
GSGFFVFSRLEVTRAEWEQKDEFICRAVHEAASPSQTVQRAVSVNPGKADPS IFhIgGwtBc15 (nucleotide sequence) (SEQ ID NO: 98)
gtt gtt tga tca gga gcc caa atc ttg tga caa aac tca cac atg ccc acc gtg ccc agc acc (63 mer)

HuIgGMHWC (sense, 5' primer for mutating wild type hinge CCC to mutant SSS)
(nucleotide sequence) (SEQ ID NO: 99)
gtt gtt gat cag gag ccc aaa tct tct gac aaa act cac aca tct cca ccg tcc cca gca cct gaa ctc ctg
ggt gga ccg tca gtc ttc c 1D8 VH (nucleotide sequence) (SEQ ID NO: 100)
caggtgcagctgaaggaggcaggacctggcctggtgcaaccgacacagaccctgtccctcacatgcactgtctctgggttctcatt
aaccagcgatggtgtacactggattcgacagcctccaggaaagggtctggaatggatgggaataatatattatgatggaggcaca
gattataattcagcaatttaaatccagactgagcatcagcagggacacctccaagagccaagttttcttaaaaatcaacagtctgcaaa
ctgatgacacagccatgtattactgtgccagaatccactttgattactggggccaaggagtcatggtcacagtctcctct 1D8 VH (no leader) (amino acid sequence) (SEQ ID NO: 101)
QVQLKEAGPGLVQPTQTLSLTCTVSGFSLTSDGVHWIRQPPGKGLEWMGIIYYDG
GTDYNSAIKSRLSISRDTSKSQVFLKINSLQTDDTAMYYCARIHFDYWGQGVMVT
VSS 1D8 VL (no leader) (nucleotide sequence) (SEQ ID NO: 102)
gacattgtgctcactcagtctccaacaaccatagctgcatctccaggggagaaggtcaccatcacctgccgtgccagctccagtgt
aagttacatgtactggtaccagcagaagtcaggcgcctcccctaaactctgatttatgacacatccaagctggcttctggagttcca
aatcgcttcagtggcagtgggtctgggacctcttattctctcgcaatcaacaccatggagactgaagatgctgccacttattactgtca
gcagtggagtagtactccgctcacgttcgggtctgggaccaagctggagatcaaacgg 1D8 VL (amino acid sequence) (SEQ ID NO: 103)
DIVLTQSPTTIAASPGEKVTTTCRASSSVSYMYWYQQKSGASPKLWIYDTSKLASG
VPNRFSGSGSGTSYSLAINTMETEDAATYYCQQWSSTPLTFGSGTKLEIKR 1D8 scFv (nucleotide sequence) (SEQ ID NO: 104)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtctgggaccaagctggagatcaaacggggtggcggtggctcggggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatc 1D8 scFv (amino acid sequence) (SEQ ID NO: 105)
MDFQVQIFSFLLISASVIMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTQLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSS 1D8 scFv IgG WTH WTCH2CH3 (nucleotide sequence) (SEQ ID NO: 106)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtctgggaccaagctggagatcaaacggggtggcggtggctcggggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatc
aggagcccaaatcttgtgacaaaactcacacatgcccaccgtgcccagcacctgaactcctggggggaccgtcagtcttcctcttc
cccccaaaacccaaggacaccccatgatctcccggacccctgaggtcacatgcgtggtggtggacgtgagccacgaagaccct
gaggtcaagttcaactggtacgtggacggcgtggaggtgcataatgccaagacaaagccgcgggaggagcagtacaacagcac
gtaccgtgtggtcagcgtcctcaccgtcctgcaccaggactggctgaatggcaaggagtacaagtgcaaggtctccaacaaagcc
ctcccagcccccatcgagaaaaccatctccaaagccaaagggcagccccgagaaccacaggtgtacaccctgcccccatcccg
ggatgagctgaccaagaaccaggtcagcctgacctgcctggtcaaaggcttctatcccagcgacatcgccgtggagtgggagag
caatgggcagccggagaacaactacaagaccacgcctcccgtgctggactccgacggctccttcttcctctacagcaagctcacc
gtggacaagagcaggtggcagcaggggaacgtcttctcatgctccgtgatgcatgaggctctgcacaaccactacacgcagaag
agcctctccctgtctccgggtaaatgatctaga 1D8 scFv IgG WTH WTCH2CH3 (amino acid sequence) (SEQ ID NO: 107)
MDFQVQIFSFLLISASVIMSRGVDIVLTQSPTTIAASPGEKVTITCRASSSVSYMYWY
QQKSGASPKLWTYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDQEPKSCDKTHTCPPCPAPELLG
GPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNYTQKSLSLSPGK 1D8 scFv IgG MTH MTCH2CH3-CD80 (nucleotide sequence) (SEQ ID NO: 108)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtctgggaccaagctggagatcaaacggggtggcggtggctcggggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacaagcccaccgagcccagcacctgaactcctggggggatcgtcagtcttcctcttcc
ccccaaaacccaaggacaccctcatgatctcccggacccctgaggtcacatgcgtggtggtggacgtgagccacgaagaccctg
aggtcaagttcaactggtacggacggcgtggaggtgcataatgccaagacaaagccgcgggaggagcagtacaacagcacg
taccgtgtggtcagcgtcctcaccgtcctgcaccaggactggctgcaaggcaaggagtacaagtgcaaggtctccaacaaagccc
tcccagcccccatcgagaaaaccatctccaaagccaaagggcagccccgagaaccacaggtgtacaccctgcccccatcccgg
gatgagctgaccaagaaccaggtcagcctgacctgcctggtcaaaggcttctatcccagcgacatcgccgtggagtgggagagc
aatgggcagccggagaacaactacaagaccacgcctcccgtgctggactccgacggctccttcttcctctacagcaagctcaccg
tggacaagagcaggtggcagcaggggaacgtcttctcatgctccgtgatgcatgaggctctgcacaaccactacacgcagaaga
gcctctccctgtctccgggtaaacggatccttcgaacctgctcccatcctgggccattaccttaatctcagtaaatggaattttgtga
tatgctgcctgactactgctttgccccaagatgcagagagagaaggaggaatgagagattgagaagggaaagtatacgccctgt
ataaatcgata 1D8 scFv IgG MTH MTCH2CH3-CD80 (amino acid sequence) (SEQ ID NO: 109)
MDFQVQIFSFLLISASVIMSRGVDIVLTQSPTTIAASPGEKVTITCRASSSVSYMYWY
QQKSGASPKLWTYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV

```
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDLEPKSSDKTHTSPPSPAPELLG
GSSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNLLPSW
AITLISVNGIFVICCLTYCFAPRCRERRRNERLRRESVRPV

1D8 scFv IgG WTH WTCH2CH3-CD80 (nucleotide sequence) (SEQ ID NO: 110)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcgggtctgggaccaagctggagatcaaacggggtggcggtggctcggacggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagtttttcttaaaaatcaacagtctg
caaactgatgacacagccatgtattactgtgccagaatccactttgattactggggccaaggagtcatggtcacagtctcctctgtct
ggagcccaaatcttgtgacaaaactcacacatgcccaccgtgcccagcacctgaactcctgggggaccgtcagtcttcctcttcc
ccccaaaacccaaggacaccctcatgatctcccggacccctgaggtcacatgcgtggtggtggacgtgagccacgaagaccctg
aggtcaagttcaactggtacgtggacggcgtggaggtgcataatgccaagacaaagccgcgggaggagcagtacaacagcacg
taccgtgtggtcagcgtcctcaccgtcctgcaccaggactggctgaatggcaaggagtacaagtgcaaggtctccaacaaagccc
tcccagcccccatcgagaaaaccatctccaaagccaaagggcagccccgagaaccacaggtgtacaccctgcccccatcccgg
gatgagctgaccaagaaccaggtcagcctgacctgcctggtcaaaggcttctatcccagcgacatcgccgtggagtgggagagc
aatgggcagccggagaacaactacaagaccacgcctcccgtgctggactccgacggctccttcttcctctacagcaagctcaccg
tggacaagagcaggtggcagcaggggaacgtcttctcatgctccgtgatgcatgaggctctgcacaaccactacacgcagaaga
gcctctccctgtctccgggtaaagcggatccttcgaacctgctcccatcctgggccattaccttaatctcagtaaatgaattttgtga
tatgctgcctgacctactgctttgccccaagatgcagagagagaaggaggaatgagagattgagaagggaaagtgtacgccctgt
ataaatcgata 1D8 scFv IgG WTH WTCH2CH3-CD80 (amino acid sequence) (SEQ ID NO: 111)
MDFQVQIFSFLLISASVIMSRGVDIVLTQSPTTIAASPGEKVTITCRASSSVSYMTWY
QQKSGASPKLWIYDTSKLASGVPNRFSDSDSDTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSCDKTHTCPPCPAPELLG
GPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNLLPSW
AITLISVNGIFVICCLTYCFAPRCRERRRNERLRRESVRPV Anti-human CD3 scFv WTH WTCH2CH3 (nucleotide sequence) (SEQ ID NO: 112)
aagcttatggattttcaagtgcagattttcagcttcctgctaatcagtgcttcagtcataatgtccagaggagtcgacatccagatgaca
cagactacatcctccctgtctgcctctctgggagacagagtcaccatcagttgcagggcaagtcaggacattcgcaattatttaaact
ggtatcagcagaaacagatggaactgttaaattcctgatctactacacatcaagattacactcaggagtcccatcaaggttcagtg
gcagtgggtctggaacagattattctctcaccattgccaacctgcaaccagaagatattgccacttactttgccaacagggtaatac
gcttccgtggacgttcggtggaggcaccaaactggtaaccaaacgggagctcggtggcggtggctcgggcggtggtgggtcgg
gtggcggcggatctatcgatgaggtccagctgcaacagtctggacctgaactggtgaagcctggagcttcaatgtcctgcaaggc
ctctggttactcattcactggctacatcgtgaactggctgaagcagagccatggaaagaaccttgagtggattggacttattaatccat
acaaaggtcttactacctacaaccagaaattcaagggcaaggccacattatagacacagtacatgtgagcagcctcacagtggag
ctcctcagtctgacatctgaagactctgcagtctattactgtgcaagatctgggtactatgtgactcggactggtacttcgatgtctgg
ggcgcagggaccacggtcaccgtctcctctgatcaggagcccaaatcttgtgacaaaactcacacatgcccaccgtgcccagcac
ctgaactcctgggggaccgtcagtcttcctcttccccccaaaacccaaggacaccctcatgatctcccggacccctgaggtcaca
tgcgtggtggtggacgtgagccacgaagaccctgaggtcaagttcaactggtacgtggacggcgtggaggtgcataatgccaag
acaaagccgcgggaggagcagtacaacagcacgtaccgtgtggtcagcgtcctcaccgtcctgcaccaggactggctgaatgg
caaggagtacaagtgcaaggtctccaacaaagcccccagccccatcgagaaaacaatctccaaagccaaagggcagcccc
gagaaccacaggtgtacaccctgcccccatcccgggatgagctgaccaagaaccaggtcagcctgacctgcctggtcaaaggct
tctatcccagcgacatcgccgtggagtgggagagcaatgggcagccggagaacaactacaagaccacgcctcccgtgctggac
tccgacggctccttcttcctctacagcaagctcaccgtggacaagagcaggtggcagcaggggaacgtcttctcatgctccgtgat
gcatgaggctctgcacaaccactacacgcagaagagcctctccctgtctccgggtaaatgatctaga Anti-human CD3 scFv WTH WTCH2CH3 (amino acid sequence) (SEQ ID NO: 113)
MDFQVQIFSFLLISASVIMSRGVDIQMTQTTSSLSASLGDRVTISCRASQDIRNYLN
WYQQKPDGTVKLLIYTSRLHSGVPSRFSGSGSGTDYSLTAINLQPEDIATYFCQQ
GNTLPWTFGGGTKLVTKRELGGGGSGGGGSGGGGSIDEVQLQQSGPELVKPGAS
MSCKASGYSFTGYIVNWLKQSHGKNLEWIGLINPYKGLTTYNQKFKGKATLTVD
KSSSTAYMELLSLTSEDSAVYYCARSGYYGDSDWYFDVWGAGTTVTVSSDQEPK
SCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYQ
KSLSLSPGK 2H7-antiCD40 scFv MTH (SSS) MTCH2WTCH3 (2h7-40.2.220Ig + restriction sites)
(nucleotide sequence) (SEQ ID NO: 114)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
```

-continued

```
taacccacccacgttcggtgctgggaccaagctggagctgaaaggtggcggtggctcgggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtactttcgatgtctggggcac
agggaccacggtcaccgtctcttctgatcaatccaactctgaagaagcaaagaaagaggaggccaaaaaggaggaagccaaga
aatctaacagcgtcgacattgttctgactcagtctccagccaccctgtctgtgactccaggagatagagtctctctttcctgcagggcc
agccagagtattagcgactacttacactggtatcaacaaaaatcacatgagtctccaaggcttctcatcaaatatgcttcccattccatc
tctgggatccccctccaggttcagtggcagtggatcagggtcagatttcactctcagtatcaacagtgtggaacctgaagatgttgaa
tttattactgtcaacatggtcacagctttccgtggacgttccggtggaggcaccaagctggaaatcaaacgggtggcggtggctcg
ggcggaggtgggtcgggtggcggcggatctcagatccagttggtgcaatctggacctgagctgaagaagcctggagagacagt
caggatctcctgcaaggcttctgggtatgccttcacaactactggaatgcagtgggtgcaagagatgccaggaaagggtttgaagt
ggattggctggataaacaccccactctggagtgccaaaatatgtagaagacttcaaggacggtttgccttctctttggaaacctctgc
caacactgcatatttacagataagcaacctcaaagatgaggacacggctacgtatttctgtgtgagatccgggaatggtaactatga
cctggcctactttgcttactggggccaagggacactggtcactgtctctgatcaggagcccaaatcttctgacaaaactcacacatcc
ccaccgtccccagcacctgaactcctgggggga tcgtcagtcttcctcttccccccaaaacccaaggacaccctcatgatctcccg
gacccctgaggtcacatgcgtggtggtggacgtgagccacgaagaccctgaggtcaagttcaactggtacgtggacggcgtgga
ggtgcataatgccaagacaaagccgcgggaggagcagtacaacagcacgtaccgtgtggtcagcgtcctcaccgtcctgcacca
ggactggctgaatggcaaggagtacaagtgcaaggtctccaacaaagcccttccagcccccatcgagaaaacaatctccaaagc
caaagggcagccccgagaaccacaggtgtacaccctgcccccatcccgggatgagctgaccaagaaccaggtcagcctgacct
gcctggtcaaaggcttctatcccagcgacatcgccgtggagtgggagagcaatgggcagccggagaacaactacaagaccacg
cctcccgtgctggactccgacggctccttcttcctctacagcaagctcaccgtggacaagagcaggtggcagcaggggaacgtct
tctcatgctccgtgatgcatgaggctctgcacaaccactacacgcagaagagcctctccctgtctccgggtaaatgatctaga
```

2H7-antiCD40 scFv MTH (SSS) MTCH2WTCH3 (2H7-40.2.220Ig) (amino acid sequence) (SEQ ID NO: 115)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKGGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQSNSEEAK
KEEAKKEEAKKSNSVDIVLTQSPATLSVTPGDRVSLSCRASQSISDYLHWYQQKSH
ESPRLLIKYASHSISGIPSRFSGSGSGSDFTLSINSVEPEDVGIYYCQHGHSFPAWTFGG
GTKLEIKRGGGGSGGGGSGGGGSQIQLWQSGPELKKPGETVRISCKASGYAFTTTG
MQWVQEMPGKGLKWIGWINTPLWSAKICRRLQGRFAFSLETSANTAYLQISNLKD
EDTATYFCVRSGNGNYDLAYFAYWGQGTLVTVSDQEPKSSDKTHTSPPSPAPELL
GGSSVFLFPPKPKDTLMISRPEVTCVVVDVSHEDPEVKFNWYVDGVEVHNAKTK
PREEQYNSTYRVVSVLTVLHQDWLNGKEYKCKVSNKALPAPIEKTISKAKGQPRE
PQVYTLPPSRDELTKNQVSLTCLVKGFYPSDIAVEWESNGQPENNYKTTPPVLDSD
GSFFLYSKLTVDKSRWQQGNVFSCSVMHEALHNHYTQKSLSLSPGK 5B9 VH (includes the VH leader peptide) (nucleotide sequence) (SEQ ID NO: 116)
atggctgtcttggggctgctcttctgcctggtgacatttccaagctgtgtcctatcccaggtgcagctgaagcagtcaggacctggcc
tagtgcagtcctcacagagcctgtccatcacctgcacagtctctggtttctcattaactacctatgctgtacactgggttcgccagtctc
caggaaagggtctggagtggctgggagtgatatggagtggtggaatcacagactataatgcagctttcatatccagactgagcatc
accaaggacgattccaagagccaagttttctttaaaatgaacagtctgcaacctaatgacacagccatttattactgtgccagaaatg
ggggtgataactacccttattactatgctatggactactgggtcaaggaacctcagtcaccgtctcctca 5B9 VH (minus the leader) (nucleotide sequence) (SEQ ID NO: 117)
caggtgcagctgaagcagtcaggacctggcctagtgcagtcctcacagagcctgtccatcacctgcacagtctctggtttctcatta
actacctatgctgtacactgggttcgccagtctccaggaaagggtctggagtggctgggagtgatatggagtggtggaatcacaga
ctataatgcagctttcatatccagactgagcatcaccaaggacgattccaagagccaagttttctttaaaatgaacagtctgcaaccta
atgacacagccatttattactgtgccagaaatgggggtgataactacccttattactatgctatggactactgggtcaaggaacctca
gtcaccgtctcctca 5B9 VH (includes leader peptide) (amino acid sequence) (SEQ ID NO: 118)
MAVLGLLFCLVTFPSCVLSQVQLKQSGPGLVQSSQSLSITCTVSGFSLTTYAVHWV
RQSPGKGLEWLGVIWSGGITDYNAAFISRLSITKDDSKSQVFFKMNSLQPNDTAIY
YCAIRNGGDNYPYYYAMDYWGQGTSVTVSS 5B9 VH (no leader peptide) (amino acid sequence) (SEQ ID NO: 119)
QVQLKQSGPGLVQSSQSLSITCTVSGFSLTTYAVHWVRQSPGKGLEWLGVIWSGGI
TDYNAAFISRLSITKDDSKSQVFFKMNSLQPNDTAIYYCARNGGDNYPYYYAMDY
WGQGTSVTVSS 5B9 VL (nucleotide sequence) (SEQ ID NO: 120)
atgaggttctctgctcagtctctggggctgcttgtgctctggatccctggatccactgcagatattgtgatgacgcaggctgcattctc
caatccagtcactcttggaacatcagcttccatctcctgcaggtctagtaagagtctcctacatagtaatggcatcacttatttgtattgg
tatctgcagaagccaggccagtctcctcagctcctgatttatcagatgtccaacctgcctcaggagtcccagacaggttcagtagca
gtgggtcaggaactgatttcacactgagaatcagcagagtggaggctgaggatgtgggtgtttattactgtgctcaaaatctagaact
tccgctcacgttcggtgctgggaccaagctggagctgaaacgg 5B9 VL (amino acid sequence) (SEQ ID NO: 121)
MRFSAQLLGLLVLWIPGSTADIVMTQAAFSNPVTLGTSASISCRSSKSLLHSNGITY
LYWYLQKPGQSPQLLIYMSNLASGVPDRFSSSGSGTDFTLRISRVEAEDVGVYYC
AQNLELPLTFGAGTKLELKR 5B9 scFv (nucleotide sequence) (SEQ ID NO: 122)
aagcttgccgccatgaggttctctgctccagctctggggctgcttgtgctctggatccctggatccactgcagatattgtgatgacgca
ggctgcattctccaatccagtcacttttggaacatcagcttccatctcctgcaggtctagtaagagtctcctacatagtaatggcatca -continued cttatttgtattggtatctgcagaagccaggccagtctcctcagctcctgatttatcagatgtccaaccttgcctcaggagtcccagaca
ggttcagtagcagtgggtcagggaactgatttcacactgagaatcagcagagtggaggctgaggatgtgggtgtttattactgtgctc
aaaatctagaacttccgctcacgttcggtgctgggaccaagctggagctgaaacggggtggcggtggctcgggcggtggtgggt
cgggtggcggcggatcgtcacaggtgcagctgaagcagtcaggacctggcctagtgcagtcctcacagagcctgtccatcacct
gcacagtctctggtttctcattaactacctatgctgtacactgggttcgccagtctccaggaaagggtctggagtggctgggagtgat
atggagtggtggaatcacagactataatgcagctttcatatccagactgagcatcaccaaggacgattccaagagccaagttttcttt
aaaatgaacagtctgcaacctaatgacacagccatttattactgtgccagaaatgggggtgataactaccttattactatgctatgga
ctactggggtcaaggaacctcagtcaccgtctcctct 5B9 scFv (amino acid sequence) (SEQ ID NO: 123)
MRFSAQLLGLLVLWIPGSTADIVMTQAAFSNPVTLGTSASISCRSSKSLLHSNGITY
LYWYLQKPGQSPQLLIYQMSNLASGVPDRFSSSSGSGTDFTLRISRVEAEDVGVYYC
AQNLELPLTFGAGTKLELKRGGGGSGGGGSGGGGSSQVQLKQSGPGLVQSSQSLS
ITCTVSGFSSLTTYAVHWVRQSPGKGLEWLGVIWSGGITDYNAAFISRLSITKDDSK
SQVFFKMNSLPNDTAIYYCARNGGDNYPYYYAMDYWGQGTSVTVSS 5B9 scFv-hmtIgG1-hCD80 (nucleotide sequence) (SEQ ID NO: 124)
aagcttgccgccatgaggttctctgctcagcttctggggctgcttgtgctctggatccctggatccactgcagatattgtgatgacgca
ggctgcattctccaatccagtcactcttggaacatcagcttccatctcctgcaggtctagtaagagtctcctacatagtaatggcatca
cttatttgtattggtatctgcagaagccaggccagtctcctcagctcctgatttatcagatgtccaaccttgcctcaggagtcccagaca
ggttcagtagcagtgggtcagggaactgatttcacactgagaatcagcagagtggaggctgaggatgtgggtgtttattactgtgctc
aaaatctagaacttccgctcacgttcggtgctgggaccaagctggagctgaaacggggtggcggtggctcgggcggtggtgggt
cgggtggcggcggatcgtcacaggtgcagctgaagcagtcaggacctggcctagtgcagtcctcacagagcctgtccatcacct
gcacagtctctggtttctcattaactacctatgctgtacactgggttcgccagtctccaggaaagggtctggagtggctgggagtgat
atggagtggtggaatcacagactataatgcagctttcatatccagactgagcatcaccaaggacgattccaagagccaagttttcttt
aaaatgaacagtctgcaacctaatgacacagccatttattactgtgccagaaatgggggtgataactaccttattactatgctatgga
ctactggggtcaaggaacctcagtcaccgtctcctctgatctggagcccaaatcttctgacaaaactcacacaagcccaccgagcc
cagcacctgaactcctggggggatcgtcagtcttcctcttccccccaaaacccaaggacaccctcatgatctcccggacccctgag
gtcacatgcgtggtggtggacgtgagccacgacgaccctgaggtcaagttcaactggtacgtggacggcgtggaggtgcataat
gccaagacaaagccgcgggaggagcagtacaacagcacgtaccgtgtggtcagcgtcctcaccgtcctgcaccaggactggct
gaatggcaaggagtacaagtgcaaggtctccaacaaagcctcccagccccatcgagaaaaccatctccaaagccaaaggc
agccccgagaaccacaggtgtacaccctgcccccatcccgggatgagctgaccaagaaccaggtcagcctgacctgcctggtca
aaggcttctatcccagcgacatcgccgtggagtgggagagcaatgggcagccggagaacaactacaagaccacgcctcccgtg
ctggactccgacggctccttcttcctctacagcaagctcaccgtggacaagagcaggtggcagcagggaacgtcttctcatgctc
cgtgatgcatgaggctctgcacaaccactacacgcagaagagcctctccctgtctccgggtaaagcggatccttcgaacctgctcc
catcctgggccattaccttaatctcagtaaatggaatttttgtgatatgctgcctgacctactgctttgccccaagatgcagagagaga
aggaggaatgagagattgagaagggaaagtgtacgccctgtataatcgatactcgag 5B9 scFv-hmtIgG1-hCD80 (amino acid sequence) (SEQ ID NO: 125)
MRFSAQLLGLLVLWIPGSTADIVMTQAAFSNPVTLGTSASISCRSSKSLLHSNGITY
LYWYLQKPGQSPQLLIYQMSNLASGVPDRFSSSGSGTDFTLRISRVEAEDVGVYYC
AQNLELPLTFGAGTKGELKRGGGGSGGGGSGGGGSSQVQLKQSGPGLVQSSQSLS
ITCTVSGFSLTTYAVHWVFQSPGKGLEWLGVIWSGGITDYNAAFISRLSITKDDSK
SQVFFKMNSLQPNDTAIYYCARNGGDNYPYYYAMDYWGQGTSVTVSSDLEPKSS
DKTHTSPPSPAPELLGGSSVFLFPPKPKSTLMISRTPEVTCVVVDVSHEDPEVKFNW
YVDGVEVHNAKTKPRRSQYNSTYRVVSVLTVLHQDWLNGKEYKCKVSNKALPA
PIEKTISKAKGQPREPQVYTLPPSRDELTKNQVSLTCLVKGFYPSDIAVEWESNGQP
ENNYKTTPPVLDSDGSFFLYSKLTVDKSRWQQGNVFSCSVMHEALHNHYTQKSLS
LSPGKADPSNLLPSWAITLISVNGIFVICCLTYCFAPRCRERRRNERLRRESVRPV 2e12 scFv WTH CH2 CH3 (2e12 scFv-WthIgG-CD80) (nucleotide sequence) (SEQ ID NO: 126)
aagcttatggatttttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctggagtggctgggaatgat
atggggtgatggaagcacagactataattcagctctcaaatccagactgaccatcaccaaggacaacctccaagagccaagttttcttt
aaaaatgaacagtctgcaaactgacgacacagccagatactactgtgccagagatggttatagtaactttcattactatgttatggact
actggggtcaaggaacctcagtcaccgtctcctcagatctggagcccaaatcttgtgacaaaactcacacatgcccaccgtgccca
gcacctgaactcctggggggaccgtcagtcttcctcttccccccaaaacccaaggacaccctcatgatctcccggacccctgaggt
cacatgcgtggtggtggacgtgagccacgaagaccctgaggtgaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaagtctccaacaaagcctcccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcagggaacgtcttctcatgctcc
gtgatgcatgaggctctgcacaaccactacacgcagaagagcctctccctgtctccgggtaaagcggatccttcgaacctgctccc
atcctgggccattaccttaatctcagtaaatggaatttttgtgatatgctgcctgacctactgctttgccccaagatgcagagagagaa
ggaggaatgagagattgagaagggaaagtgtacgccctgtataatcgat 2e12 scFv WTH CH2 CH3 (2e12 scFv-WthIgG-CD80) (amino acid sequence) (SEQ ID NO: 127)
MDQVQIFSFLLISASVIMSRGVDIVLTQSPASLAVSLGQRATISCRASESVEYYVTS
LMQWYQQKPGQPPKLLLSAASNVESGVPARFSGSGSGTDFSLNIHPVEEDDIEMYF
CQQSRKVPWTFGGGTKLEIKRGGGGSGGGGSGGGGSQVQLKESGPGLVAPSQSLS
ITCTVSGFSLTGYGVIWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
CDKTHTCPPCPAPELLGGPSVFLFPPKPKDTLMISRTPEVTCVVVDVSHEDPEVKFN
WYVDCVEVHNAKTKPREEQYNSTYRVVSVLTVLHQDWLNGKEYKCKVSNKALP -continued APIEKTISKAKGQPREPQVYTLPPSRDELTKNQVSLTCLVKSFYPSDIAVEWESNGQ
PENNYKTTPPVLDSDGSFFLYSKLTVDKSRWQQGNVFSCSVMHEALHNHYTQKSL
SLSPGKADPSNLLPSQAITLISVNGIFVICCLTYCFAPRCRERRRNERLRRESVRPV 2H7-human IgE Fc (CH2-CH3-CH4) (nucleotide sequence) (SEQ ID NO: 128)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccaccacgttcggtgctgggaccaagctggagctgaaaggtggcggtggctcggcggtggtggatctggaggaggtg
ggagctctcaggcttatctacagcagtctggggctgagctggtgaggcctgggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctctgatcacgtctgctccagggacttcaccccgccaccgtgaagatcttacagtcgtcctgcgacg
gcggcgggcacttcccccgaccatccagctcctgtgcctcgtctctgggtacaccccagggactatcaacatcacctggctgga
ggacgggcaggtcatggacgtggacttgtccaccgcctctaccacgcaggagggtggcctccacacaaagcgagctca
ccctcagccagaagcactggctgtcagaccgcacctacacctgccaggtcacctatcaaggtcacaccttgaggacgaccaa
gaagtgtgcagattccaacccgagaggggtgagcgcctacctaagccggcccagcccgttcgacctgttcatccgcaagtcgcc
cacgatcacctgtctggtggtggacctggcacccagcaaggggaccgtgaacctgacctggtcccggggccagtgggaagcctgt
gaaccactccaccagaaaggaggagaagcagcgcaatggcacgttaaccgtcacgtccaccctgccggtgggcacccgagact
ggatcgaggggagacctaccagtgcagggtgacccaccccacctgcccaggcctcatgcggtccacgaccag
cggcccgcgtgctgccccggaagtctatgcgtttgcgacgccggagtggccggggagccgggacaagcgcaccctcgcctgc
ctgatccagaacttcatgcctgaggacaactcggtcagtggctgcacaacgaggcagctcccggacgcccggcacagcacg
acgcagccccgcaagaccaaggctccggcttcttcgtcttcagccgcctggaggtgaccagggccgaatgggagcagaaga
tgagttcatctgccgtgcagtccatgaggcagcgagccctcacagaccgtccagcgagcggtgtctgtaaatcccggtaaatgat
aatctaga 2H7 scFv IgE (CH2-CH3-CH4) (amino acid sequence) (SEQ ID NO: 129)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKGGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSDHVCSRDFTP
PTVKILQSSCDGGGHFPPTIQLLCLVSGYTGTINITWLEDGQVMDVDLSTASTTQE
GELASTQSELTLSQKHWLSDRTYTCQVTYQGHTFEDSTKKCADSNPRGVSAYSLR
PSPFDLFIRLSPTITCLVVDLAPSKGTVNLTWSRASGKPVNHSTRKEEKQRNGTLTV
TSTLPVGTRDWIEGETYQCRVTHPHLPRALMRSTTKTSGPRAAPEVYAFATPEWP
GSRDKRTLACLIQNFMPEDISVQWLHNEVQLPDARHSTTQPRKTKGSGFFVFSRLE
VTRAEWEQKDEFICRAVHEAASPSQTVQRAVSVNPGK 2H7 scFv MH (SSS) MCH2WTCH3 (nucleotide sequence) (SEQ ID NO: 130)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccaccacgttcggtgctgggaccaagctggagctgaaaggtggcggtggctcggcggtggtggatctggaggaggtg
ggagctctcaggcttatctacagcagtctggggctgagctggtgaggcctgggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcacctgaac
tcctggggggatcgtcagtcttcctcttcccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtggtcagcgtcctcaccgtcctgcaccaggactggctgaatggcaagga
gtacaagtgcaaggtctccaacaaagcccccagccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacagcagaagagcctctccctgtctccgggtaaatgatctaga 2H7 scFv MH (SSS) MCH2WTCH3 (amino acid sequence) (SEQ ID NO: 131)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPAPELLGGSSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 5B9 scFv MTHWTCH2CH3 (nucleotide sequence) (SEQ ID NO: 132)
aagcttgccgccatgagggttctctgctcagcttctggggctgcttgtgctctggatcccggatccactgcagatattgtgatgacgca
ggctgcattctccaatccagtcactcttggaacatcagcttcatcctcctgcagctctagtaagagtctcctacatagtaatggcatca
cttatttggtatctgcagaagccaggccagtctcctcagctcctgatttatcagatgtccaacctgcctcaggaatcccagaca
ggttcagtagcagtgggtcaggaactgatttcacactgagaatcagcagagtggaggctgaggatgtgggtgtttattactgtgctc
aaaatctagaacttccgctcacgttcggtgctgggaccaagctggagctgaaacggggtggcggtggctcggcggtggtgggt
cggggtggcggcggatcgtcacaggtgcagctgaagcagtcaggacctggcctagtgcagtcctcacagagcctgtccatcacct -continued gcacagtctctggtttctcattaactacctatgctgtacactgggttcgccagtctccaggaaagggtctggaggtggctgggagtgat
atggagtggtggaatcacagactataatgcagctttcatatccagactgagcatcaccaaggacgattccaagagccaagtttttcttt
aaaatgaacagtctgcaacctaatgacacagccatttcttactgtgccagaaatgggggtgataactaccttattactatgctatgga
ctacctggggtcaaggaacctcagtcaccgtctcctctgatcaggagcccaaatcttctgacaaaactcacacatcccaccgtcccc
agcacctgaactcctgggggaccgtcagtcttcctcttccccccaaaaccaaggacaccctcatgatctcccggacccctgag
gtcacatgcgtggtggtggacgtgagccacgaagaccctgaggtcaagttcaactggtacgtggacggcgtggaggtgcataat
gccaagacaaagccgcgggaggagcagtacaacagcacgtaccgtgtggtcagcgtcctcaccgtcctgcaccaggactggct
gaatggcaaggagtacaagtgcaaggtctccaacaaagcccctcccagcccccatcgagaaaacaatctccaaagccaaagggc
agccccgagaaccacaggtgtacaccctgcccccatcccgggatgagctgaccaagaaccaggtcagcctgacctgcctggtca
aaggcttctatcccagcgacatcgccgtggagtgggagagcaatgggcagccggagaacaactacaagaccacgcctcccgtg
ctggactccgacggctccttcttcctctacagcaagctcaccgtggacaagagcaggtggcagcaggggaacgtcttctcatgctc
cgtgatgcatgaggctctgcacaaccactacacgcagaagagcctctccctgtctccgggtaaatgatctaga 5B9 scFv MTHWTCH2CH3 (amino acid sequence) (SEQ ID NO: 133)
MRFSAQLLGLLVLWIPGSTADIVMTQAAFSNPVTLGTSASISCRSSKSLLHSNGITY
YWYLQKPGQSPQLLIYQMSNLASGVPDRFSSSGSGTDFTLRISRVEAEDVGVYYC
AQNLELPLTFGAGTKLELKRGGGGSGGGGSGGGGSSQVQLKQSGPGLVQSSQSLS
ITCTVSGFSLTTYAVHWVRQSPGKGEWLGVIWSGGITDYNAAFISRLSITKDDSK
SQVFFKMNSLQPNDTAIYYCARNGGDNYPYYYAMDYWGQGTSVTVSSDQEPKSS
DKTHTSPPSPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPA
PIEKTISKAKGQPREPQVYTLPPSRDELTKNQVSLTCLVKGFYPSDIAVEWESNGQP
ENNYKTTPPVLDSDGSFFLYSKLTVDKSRWQQGNVFSCSVMHEALHNHYTQKSLS
LSPGK Human IgG1 hinge mutations
2H7 scFv-MTH (CSS) WTCH2CH3 (nucleotide sequence) (SEQ ID NO: 134)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaacctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggaatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatccccaccgtcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaagccctcccagcccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv-MTH (CSS) WTCH2CH3 (amino acid sequence) (SEQ ID NO: 135)
MDFQVQIFSFLLISASVIIARGQIVLSQSPAILSASGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDK
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 2H7 scFv-MTH (SCS) WTCH2CH3 (nucleotide sequence) (SEQ ID NO: 136)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaacctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggaatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatgccccaccgtcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacgcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccctcccagcccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv-MTH (SCS) WTCH2CH3 (amino acid sequence) (SEQ ID NO: 137)
MDFQVQIFSFLLISASVIIARGQIVLSQSPAILSASGEKVTMTCRASSSVSYMHWY
QQKKPGSSPKPWIYAPSNLASGVPARFSGSGSGTSYSLTISRRVEAEDAATYYCQQWS
FNPPTFGAGTKLELKDGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 2H7 scFv-MTH (SSC) WTCH2CH3 (nucleotide sequence) (SEQ ID NO: 138)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaacctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggccggtggtggatcggaggaggtg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctattctgtgcaagagtggtgtactatagtaactcttactggtacttcgatgtctgggcac
agggaccacggtcaccgtctcttctgatcaggagcccaaatcttctgacaaaactcacacatgcccaccgtgcccagcacctgaac
tcctggggggaccgtcagtcttcctcttccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagccctcccagcccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv-MTH (SSC) WTCH2CH3 (amino acid sequence) (SEQ ID NO: 139)
MDFQVQIFSFLLISASVIIARGQIVLSQSPAILSASGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGSGGGGSGGGGSSQAYLQQSGAELVRPGASVKMSCK
ASGYTFTSYNMHWVKQTFRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPCPAPELLGGPSVFLFPPKPKDTLMMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK HIgGMHcys1 (nucleotide sequence) (SEQ ID NO: 140)
gtt gtt gat cag gag ccc aaa tct tct gac aaa act cac aca tg HIgGMHcys2 (nucleotide sequence) (SEQ ID NO: 141)
gtt gtt gat cag gag ccc aaa tct tgt gac aaa act cac aca tct cca ccg tgc HIgGMHcys3 (nucleotide sequence) (SEQ ID NO: 142)
gtt gtt gat cag gag ccc aaa tct tgt gac aaa act cac aca tgt cca ccg tcc cca gca cct HuIgG1 MTCH3Y405 (nucleotide sequence) (SEQ ID NO: 143)
gggcagccccgagaaccacaggtgtacaccctgcccccatcccgggaggagatgaccaagaaccaggtcagcctgacctgcct
ggtcaaaggcttctatcccagcgacatcgccgtggagtgggagagcaatgggcagccggagaacaactacaagaccacgcctc
ccgtgctggactccgacggctccttctacctctatagcaagctcaccgtggacaagagcaggtggcagcaggggaacgtcttctc
atgctccgtgatgcatgaggctctgcacaaccactacacgcagaagagcctctccctgtccccgggtaaatga HuIgG1 MTCH3Y405 (amino acid sequence) (SEQ ID NO: 144)
GQPREPQVYTLPPSREEMTKNQVSLTCLVKGFYPSDIAVEWESNGQPENNYKTTPP
VLDSDGSFYLYSKLTVDKSRWQQGNVFSCSVMHEALHNHYTQKSLSLSPGK HuIgG1 MTCH3A405 (nucleotide sequence) (SEQ ID NO: 145)
gggcagccccgagaaccacaggtgtacaccctgcccccatcccgggaggagatgaccaagaaccaggtcagcctgacctgcct
ggtcaaaggcttctatcccagcgacatcgccgtggagtgggagagcaatgggcagccggagaacaactacaagaccacgcctc
ccgtgctggactccgacggctccttcgccctctatagcaagctcaccgtggacaagagcaggtggcagcaggggaacgtcttctc
atgctccgtgatgcatgaggctctgcacaaccactacacgcagaagagcctctccctgtccccgggtaaatga HuIgG1 MTCH3A405 (amino acid sequence) (SEQ ID NO: 146)
GQPREPQVYTLPPSREEMTKNQVSLTCLVKGFYPSDIAVEWESNGQPENNYKTTPP
VLDSDGFALYSKLTVDKSRWQQGNVFSCSVMHEALHNHYTQKSLSLSPGK HuIgG1 MTCH3A407 (nucleotide sequence) (SEQ ID NO: 147)
Gggcagccccgagaaccacaggtgtacaccctgcccccatcccgggaggagatgaccaagaaccaggtcagcctgacctgcc
tggtcaaaggcttctatcccagcgacatcgccgtggagtgggagagcaatgggcagccggagaacaactacaagaccacgcct
cccgtgctggactccgacggctccttcttcctcgccagcaagctcaccgtggacaagagcaggtggcagcaggggaacgtcttct
catgctccgtgatgcatgaggctctgcacaaccactacacgcagaagagcctctccctgtccccgggtaaatga HuIgG1 MTCH3A407 (amino acid sequence) (SEQ ID NO: 148)
GQPREPQVYTLPPSRESMTKNQVSLTCLVKGFYPSDIAVEWESNGQPENNYKTTPP
VLDSDGSFFLASKLTVDKSRWQQGNVFSCSVMHEALHNHYTQKSLSLSPGK HuIgG1 MTCH3Y405A407 (nucleotide sequence) (SEQ ID NO: 149)
gggcagccccgagaaccacaggtgtacaccctgcccccatcccgggaggagatgaccaagaaccaggtcagcctgacctgcct
ggtcaaaggcttctatcccagcgacatcgccgtggagtgggagagcaatgggcagccggagaacaactacaagaccacgcctc
ccgtgctggactccgacggctccttctacctcgccagcaagctcaccgtggacaagagcaggtggcagcaggggaacgtcttctc
atgctccgtgatgcatgaggctctgcacaaccactacacgcagaagagcctctccctgtccccgggtaaatga HuIgG1 MTCH3Y405A407 (amino acid sequence) (SEQ ID NO: 150)
GQPREPQVYTLPPSREEMIKNQVSLTCLVKGFYPSDIAVEWESNGQPENNYKTTPP
VLDSDGSFYLASKLTVDKSRWQQGNVFSCSVMHEALHNHYTQKSLSLSPGK HuIgG1 MTCH3A405A407 (nucleotide sequence) (SEQ ID NO: 151)
gggcagccccgagaaccacaggtgtacaccctgcccccatcccgggaggagatgaccaagaaccaggtcagcctgacctgcct
ggtcaaaggcttctatcccagcgacatcgccgtggagtgggagagcaatgggcagccggagaacaactacaagaccacgcctc
ccgtgctggactccgacggctccttcgccctcgccagcaagctcaccgtggacaagagcaggtggcagcaggggaacgtcttct
catgctccgtgatgcatgaggctctgcacaaccactacacgcagaagagcctctccctgtccccgggtaaatga HuIgG1 MTCH3A405A407 (amino acid sequence) (SEQ ID NO: 152)
GQPREPQVYTLPPSREEMTKNQVSLTCLVKGFYPSDIAVEWESNGQPENNYKTTPP
VLDSDGSFALASKLTVDRSRWQQGNVFSCSVMHEALHNHYTQKSLSLSPGK 2H7 scFv MTH (SSS) WTCH2MTCH3Y405 (nucleotide sequence) (SEQ ID NO: 153)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcacctgaac
tcctggggggaccgtcagtcttcctcttccccccaaaacccaaggacaccctcatgatctcccggaccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccctcccagccccatcgagaaaacaatcctccaaagccaaagggcagccccgagaac
cacaggtgtacaccctgcccccatcccgggaggagatgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttctacctctatagcaagctcaccgtggacaagagcaggtggcagcaggggaacgtcttctcatgctccgtgatgcatga
ggctctgcacaaccactacacgcagaagagcctctccctgtccccgggtaaatgatctaga 2H7 scFv MTH (SSS) WTCH2MTCH3Y405 (amino acid sequence) (SEQ ID NO: 154)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSREEMKNQVSLTCLVKGFYPSDIAVEWESNGQPEN
NYKTTPPVLDSDGSFYLYSKLTVDKSRWQQGNVFSCSVMHEALHNHYTQKSLSLS
PGK 2H7 scFv MTH (SSS) WTCH2MTCH3A405 (nucleotide sequence) (SEQ ID NO: 155)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcacctgaac
tcctggggggaccgtcagtcttcctcttccccccaaaacccaaggacaccctcatgatctcccggaccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccctcccagccccatcgagaaaacaatcctccaaagccaaagggcagccccgagaac
cacaggtgtacaccctgcccccatcccgggaggatgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcgccctctatagcaagctcaccgtggacaagagcaggtggcagcaggggaacgtcttctcatgctccgtgatgcatga
ggctctgcacaaccactacacgcagaagagcctctccctgtccccgggtaaatga 2H7 scFv MTH (SSS) WTCH2MTCH3A405 (nucleotide sequence) (SEQ ID NO: 156)
mdfqvqifsfllisasviiargqivlsqspailsaspgekvtmtcrasssvsymhwyqqkpwiyapsnlasgvparf
sgsgsgtsysltisrveaedaatyycqqwsfnpptfgagtklelkdgggsggggsggggssqaylqqsgaelvrpgasvkmsc
kasgytftsynmhwvkqtprqglewigaiypgngdtsynqkfkgkatltvdkssstaymqlssltsedsavyfcarvvyysn -continued sywyfdvwgtgttvtvssdqepkssdkthtsppspapellggpsvflfppkpkdtlmisrtpevtcvvvdvshedpevkfnw
yvdgvevhnaktkpreeqynstyrvvsvltvlhqdwlngkeykckvsnkalpapiektiskakgqprepqvytlppsreemt
knqvsltclvkgfypsdiavewesngqpennykttppvldsdgsfalyskltvdksrwqqgnvfscsvmhealhnhytqksl
slspgk 2H7 scFv MTH (SSS) WTCH2MTCH3A407 (nucleotide sequence) (SEQ ID NO: 157)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcacctgaac
tcctgggggaccgtcagtcttcctcttcccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcggggaggagcagtacaacagcacgtaccgtgtggtcagcgtcctcaccgtcctgcaccaggactggctgaatggcaagga
gtacaagtgcaaggtctccaacaaagccctcccagcccccatcgagaaaacaatctccaaagccaaagggcagccccgagaac
cacaggtgtacaccctgcccccatcccgggaggagatgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctcgccagcaagctcaccgtggacaagagcaggtggcagcaggggaacgtcttctcatgctccgtgatgcatga
ggctctgcacaaccactacacgcagaagagcctctccctgtcccgggtaaatga 2H7 scFv MTH (SSS) WTCH2MTCH3A407 (amino acid sequence) (SEQ ID NO: 158)
MDFQVQWSFLLISASVIIARGQIVLSQSPAILSASPGEKVTMTCRASSSVSYMIIWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSGK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYILPPSREEMTKNQVVSLTCLVKGYPSDIAVEWESNGQPEN
NYKTTPPVLDSDGSFFLASKLTVDKSRWQQGNVFSCSVMHEALHNHYTQKSLLS
PGK 2H7 scFv MTH (SSS) WTCH2MTCH3Y405A407 (nucleotide sequence) (SEQ ID NO: 159)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttcagatcaggagcccaaatcttctgacaaaactcacacatccccaccgtcccagcacctgaac
tcctgggggaccgtcagtcttcctcttcccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcggggaggagcagtacaacagcacgtaccgtgtggtcagcgtcctcaccgtcctgcaccaggactggctgaatggcaagga
gtacaagtgcaaggtctccaacaaagccctcccagcccccatcgagaaaacaatctccaaagccaaagggcagccccgagaac
cacaggtgtacaccctgcccccatcccgggaggagatgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctcgccagcaagctcaccgtggacaagagcaggtggcagcaggggaacgtcttctcatgctccgtgatgcatga
aggctctgcacaaccactacacgcagaagagcctctccctgtcccgggtaaatga 2H7 scFv MTH (SSS) WTCH2MTCH3Y405A407 (amino acid sequence) (SEQ ID NO: 160)
MDFQVQIFSFLLISASVILAPGQIVLSQSPAILSASGEKVTMTCRESSSVSYMHHWY
QQKPGSSPKPWIYAPSNLASGVPARFSGSGSGTSYSLTISRVEAEDAATYYCQQWS
FNPPTFGAGTKLEIKDGGGSGGGGSGGGGSSQAYLQQSGAELVRPGASVKMSCK
ASGYTFTSYNMHWVKQTPRQGLEWIGAIYPGNGDTDYNQKFKGKATLTVDKSSS
TAYMQLSSLTSEDSAVYFCARVVYYSNSYWYFDVWGTGTTVTVSSDQEPKSSDK
THTSPPSPAPELLGGPSVFLFPPKPKDTLMISRTPEVTCVVVDVSHEDPEVKFNWYV
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSREEMTKNQVVSLTCLVKGFYPSDIAVEWESNGQPEN
NYKTTPPVLDSDGSFYLASKLTVDKSRWQQGNVFSCSCMHEALHNHYTQKSLSLS
PGK 2H7 scFv MTH (SSS) WTCH2MTCH3A405A407 (nucleotide sequence) (SEQ ID NO: 161)
aagcttgccgccatggattttcaagtgcagatatcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctgggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac -continued agggaccacggtcaccgtctcttctgatcaggagcccaaatcttctgacaaaactcacacatccccaccgtcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcccgtaccgtgtggtcagcgtcctcaccgtcctgcaccaggactggctgaatggcaagga
gtacaagtgcaaggtctccaacaaagcccccagccccatcgagagaaaacaatctccaaagccaaagggcagccccgagaac
cacaggtgtacaccctgcccccatcccgggaggagatgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcgcctcgccagcaagctcaccgtggacaagagcaggtggcagcaggggaacgtcttctcatgctccgtgatgcatg
aggctctgcacaaccactacacgcagaagagcctctccctgtccccgggtaaatga 2H7 scFv MTH (SSS) WTCH2MTCH3A405A407 (amino acid sequence) (SEQ ID NO: 162)
MDFQVQIFSFLLISASVIIARGQIVLSQSPAILSASGEKVTMCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPEN
NYKTTPPVLDSDGSFALASKLTVDKSRWQQGNVFSCSVMHEALHNHYTQKSLSLS
PGK 2H7 scFv MTH (SCC) WTCH2CH3 (nucleotide sequence) (SEQ ID NO: 163)
aagcttgccgccatggattttcaagtgcagcttttcagcttcctgctaatcagtgcttcagtcataattgccagaggacaaattgttctct
cccagtctccagcaatcccgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcaaaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatgcccaccgtgcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccccagccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv MTH (SCC) WTCH2CH3 (amino acid sequence) (SEQ ID NO: 164)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKSCK
ASGYTFTSYNMHWVKQTPRQGLEWIGAIYPGNGDTSYNQKFKGKATLTVDKSSS
TAYMQLSSLTSEDSAVYFFCARVVYYSNSYWYFDVWGTGTTVTVSSDQEPKSSDK
THTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 2H7 scFv MTH (CSC) WTCH2CH3 (nucleotide sequence) (SEQ ID NO: 165)
aagcttgccgccatggattttcaagtgcagattttcagcttcctgctaatcagtgcttcagtcataattgccagaggacaagttgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatctccaccgtgcccagcacctgaac
tcctgggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccccagccccatcgagaaaacaatctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga 2H7 scFv MTH (CSC) WTCH2CH3 (amino acid sequence) (SEQ ID NO: 166)
MDFQVQIFSFLLISASVIIARGQIVLSQSPAILSASPGEKVTMCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYPCARVVYYSNSYWYFDVWGTGTTVTVSSDQEPKSCDK

```
THTSPPCPAPELLGGPSVFCFFPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSEFLYSKLTVDKSRWQQGNVFSCSVMHEALHNHYTQKSLSL
SPGK
```

2H7 scFv MTH (CCS) WTCH2CH3 (nucleotide sequence) (SEQ ID NO: 167)
```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagagtggaggctgaagatgctgccacttattactgccagcagtggagttt
taacccacccacgttcggtgctgggaccaagctggagctgaaagatggcggtggctcggccggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatgtccaccgtcccagcacctgaac
tcctggggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcggggaggagcagtacaacagcacgtaccgtgtggtcagcgtcctcaccgtcctgcaccaggactggctgaatggcaagga
gtacaagtgcaaggtctccaacaaagcccccagccccatcgagaaaaccatcccaaagccaaagggcagccccgagaac
cacaggtgtacaccctgccccatcccgggatgagctgaccaaagaaccaggtcagcctgacctgcctggtcaaaggcttctatcc
cagcgacatcgccgtggggtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga
```

2H7 scFv MTH (CCS) WTCH2CH3 (amino acid sequence) (SEQ ID NO: 168)
```
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEOKSCDK
THTCPPSPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSSNKALPAPI
EKTISKAKGQPREPQVYTLPPSRDELTKNQVSLTCLVKGFYSDIAVEWESNGQPE
NNYKTTPPVLDSDGSFFLYSKLTVDKSRWQQGNVFSCSVMHEALHNHYTQKSLSL
SPGK
```

HuIgAHIgA-T4-ORF (nucleotide sequence) (SEQ ID NO: 169)
```
tgatcagccagttccctcaactccacctacccatccctcaactccacctacccatctccctcatgctgccaccccgactgtca
ctgcaccgaccggccctcgaggacctgctcttaggttcagaagcgatcctcacgtgcacactgaccggcctgagagatgcctcag
gtgtcaccttcacctggacgccctcaagtgggaagagcgctgttcaaggaccacctgaccgtgacctctgtggctgctacagcgtg
tccagtgtcctgccgggctgtgccgagccatggaaccatgggaagaccttcacttgcactgctgcctaccccgagtccaagaccc
cgctaaccgccaccctctcaaaatccggaaacacattccggcccgaggtccacctgctgccgccgccgcctcggaggagctggccc
tgaacgagctggtgacgctgacgtgcctggcacgtggcttcagccccaaggatgtgctggttcgctggctgcaggggtcacagg
agctgccccgcgagaagtacctgacttgggcatcccggcaggagcccagccagggcaccaccaccttcgctgtgaccagcata
ctgcgcgtggcagccgaggactggaagaaggggggacaccttctcctgcatggtgggccacgaggccctgccgctggccttcac
acagaagaccatcgaccgcttggcgggtaaacccacccatgtcaatgtgtctgttgtcatggcggaggtggacgcggatccttcga
ac
```

HuIgAHIgA-T4-ORF (amino acid sequence) (SEQ ID NO: 170)
```
DQPVPSTPPTPSPSTPPTPSPSCCHPRLSLHRPALEDLLLGSEAILTCTLTGLRDASGV
TFTWTPSSGKSAVQGPPDRDLCGCYSVSSVLPGCAEPWNHGKTFTCTAAYPESKT
PLTATLSKSGNTFRPEVHLLPPPSEELALNELVTLTCLARGFSPKDVLVRWLQGSQ
ELPREKYLTWASRQEPSQGTTTFAVTSILRVAAEDWKKGDTFSCMVGHEALPLAF
TQKTIDRLAGKPTHVNVSVVMAEVDADPSN
```

1D8-IgAH IgA-T4-CD80 (nucleotide sequence) (SEQ ID NO: 171)
```
aagcttatgattttcaagtgcagattttcagcttcctgctaatcagtgcttcagtcatAatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtgctgggaccaagctggagatcaaacggggtggcggttcaggcggtggtggatctggcggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagcttataattcagcaattaaatccagactgagcatcagcagggacacctccaagagccaagttttcttaaaaatcaacagtctg
caaactgatgacacagccatgtattactgtgccagaatccattctgattactggggccaaggagtcatggtcacagtctcctctgatc
agccagttccctcaactccacctacccaactcctcaactccacctaccccatctccctcatgctgccaccccgactgtcactgca
ccgaccggccctcgaggacctgctcttaggttcagaagcgatcctcacgtgcacactgaccggcctgagagatgcctcaggtgtc
accttcacctggacgccctcaagtgggaagagcgctgttcaaggaccacctgaccgtgacctctgtggctgctacagcgtgtcca
gtgtcctgccgggctgtgccgagccatggaaccatgggaagaccttcacttgcactgctgcctaccccgagtccaagaccccgct
aaccgccaccctctcaaaatccggaaacacattccggcccgaggtccacctgctgccgccgccgcctcggaggagctggccc
tgaacgagctggtgacgctgacgtgcctggcacgtggcttcagccccaaggatgtgctggttcgctggctgcaggggtcacaggagct
gccccgcgagaagtacctgacttgggcatcccggcaggagcccagccagggcaccaccaccttcgctgtgaccagcatactgc
gcgtggcagccgaggactggaagaaggggggacaccttctcctgcatggtgggccacgaggccctgccgctggccttcacacag
aagaccatcgaccgcttggcgggtaaacccacccatgtcaatgtgtctgttgtcatggcggaggtggacgcggatccttcgaacaa
cctgctcccatcctgggccattaccttaatctcagtaaatggaattttttgtgatatgctgcctgacctactgctttgccccaagatgcag
agagagaaggaggaatgagagattgagaagggaaagtgtacgccctgtataaaatcgatac
```

AA

-continued

1D8 scFv IgAH IgA-T4-CD80 (amino acid sequence) (SEQ ID NO: 172)
MDFQVQIFSFLLISASVLMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDQPVPSTPPTPSPSTPPTPSPSCC
HPRLSIHRPALEDLLLGSEAILTCTLTGLRDASGVTFTWTPSSGKSAVQPPDRDL
CGCYCVSSVLPGCAEPWNHGKTFTCTAAYPEASKTPLTATLSKSGNTFRPEVHLLPP
PSEELALNELVTLTCLARCFSPKDVLVRWLQGSQELPREKYLTWASRQEPSQGTTT
FAVTSILRVAAEDWKKGDTFSCMVGHEALPLAFTQKTIDRLAGKPTHVNVSVVM
AEVDADPSNNLLPSWAITLISVNGIFVICCLTYCFAPRCRERRRNERLRRESVRPV human IgE Fc (CH2-CH3-CH4) ORF (nucleotide sequence) (SEQ ID NO: 173)
tgatcacgtctgctccagggacttcaccccgccaccgtgaagatcttacagtcgtcctgcgacggcggcgggcacttccccccg
accatccagctcctgtgcctcgtctctgggtacaccccagggactatcaacatcacctggctggaggacgggcaggtcatggacg
tggacttgtccaccgcctctaccaogcaggagggtgagctggcctccacacaaagcgagctcaccctcagcagaagcactggc
tgtcagaccgcacctacacctgccaggtcacctatcaaggtcacacctttgaggacagcaccaagaagtgtgcagattccaaccc
gagaggggtgagcgcctacctaagccggcccagcccgttcgacctgttcatccgcaagtcgcccacgatcacctgtctggtggtg
gacctggcacccagcaagggaccgtgaacctgacctggtccccgggccagtgggaagcctgtgaaccactccaccagaaagg
aggagaagcagcgcaatggcacgttaaccgtcacgtccaccctgccggtgggcacccgagactggatcgagggggagaccta
ccagtgcagggtgacccaccccaccctgcccagggccctcatgcggtccacgaccaagaccagcggcccgcgtgctgcccg
gaagtctatgcgtttgcgacgccggagtggccggggagccgggacaagcgcaccctcgcctgcctgatccagaacttcatgcct
gaggacatctcggtgcagtggctgcacaacgaggtgcagctcccggacgcccggcacagcacgacgcagccccgcaagacc
aagggctccggcttcttcgtcttcagccgcctggaggtgaccagggccgaatgggagcagaaagatgagttcatctgccgtgcag
tccatgaggcagcgagcccctcacagaccgtccagcgagcggtgtctgtaaatcccggtaaagcggatccttcgaa AA
human IgE Fc (CH2-CH3-CH4) ORF (amino acid sequence) (SEQ ID NO: 174)
DHVCSRDFTPPTVKILQSSCDGGGHFPPTIQLLCLVSGYTPGTINITWLEDGQVMDV
DLSTASTTQEGLASTQSELTLSQKHWLSDRTYTCQVTYQGHTFEDSTKKCADSN
PRGCSAYLSRPSPFDLFIRKSPTITCLVVDLAPSKGTVNLTWSRASGKPVNHSTRKE
EKQRNGTLTVTSTLPVGTRDWIEGETYQCRVTHPHLPRALMRSTTKTSGPRAAPE
VYAFATPEWPGSRDKRTLACLIQNFMPEDISVQWLHNEVQLPDARHSTTQPRKTK
GSGFFVFSRLEVTRAEWEQKDEFICRAVHEAASPSQTVQRAVSVNPGKADPS 1D8 scFv-human IgE Fc (CH2-CH3-CH4)-CD80 (nucleotide sequence) (SEQ ID NO: 175)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcgggtctgggaccaagctggagatcaaacggggtggcggtggctcgggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatc
acgtctgctccaggacttcaccccgcccaccgtgaagatcttacagtcgtcctgcgacggcggcgggcacttcccccgaccat
ccagctcctgtgcctcgtctctgggtacaccccagggactatcaacatcacctggctggaggacgggcaggtcatggacgtggac
ttgtccaccgcctctaccacgcaggagggtgagctggcctccacacaaagcgagctcaccctcagccagaagcactggctgtca
gaccgcacctacacctgccaggtcacctatcaaggtcacacctttgaggacagcaccaagaagtgtgcagattccaacccgagag
gggtgagcgcctacctaagccggcccagcccgttcgacctgttcatccgcaagtcgcccacgatcacctgtctggtggtggacct
ggcacccaggaaggggaccgtgaacctgacctggtcccgggccagtgggaagcctgtgaaccactccaccagaaaggaggag
aagcagcgcaatggcacgttaaccgtcacgtccaccctgccggtgggcacccgagactggatcgagggggagacctaccagtg
cagggtgacccaccccacctgcccagggccctcatgcggtccacgaccaagaccagcggcccgcgtgctgccccggaagtct
atgcgtttgcgacgccggagtggccggggagccgggacaagcgcaccctcgcctgcctgatccagaacttcatgcctgaggac
atctcggtgcagtggctgcacaacgaggtgcagctcccggacgcccggcacagcacgacgcagccccgcaagaccaagggct
ccggcttcttcgtcttcagccgcctggaggtgaccagggccgaatgggagcagaaagatgagttcatctgccgtgcagtccatga
ggcagcgagcccctcacagaccgtccagcgagcggtgtctgtaaatcccggtaaagcggatccttcgaagctcccatcctgggc
cattaccttaatctcagtaaatggaatttttgtgatatgctgcctgacctactgctttgccccaagatgcagagagagaaggaggaatg
agagattgagaagggaaagtgtacgccctgtataaatcgata 1D8-scFv-human IgE Fc (CH2-CH3-CH4)-CD80 (amino acid sequence) (SEQ ID NO: 176)
MDFQVQIFSFLLISASVLMSRGVDIVLTQSPTTJAASPGEKVTITCPASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDHVCSRDFTPPTVKILQSSCDGG
GHFPPTIQLLCLVSGYTPGTINITWLEDGQVMDVDLSTASTTQEGELASTQSELTLS
QKHWLSDRTYTCQVTYQGHTFEDSTKKCADSNPRGVSAYLSRPSPFDLFIRKSPTI
TCLVVDLAPSKGTVNLTWSRASGKPVNHSTRKEEKQRNGTLTVTSTLPBGTRDWI
EGETYQCRVTHPHLPRALMRSTTKTSGPRAAPEVYAFATPEWPGSRDKRTLACLI
QNFMPEDISVQWLHNEVQLPDARHSTTQPRKTKGSGFFVFSRLEVTRAEWEQKDE
FICRAVHEAASPSQTVQRAVSVNPGKAKPSKLPSWAITLISVNGIFVICCLTYCFAP
RCRERRRNERLRRESVRPV 5B9-IgAH IgA-T4-CD80 (nucleotide sequence) (SEQ ID NO: 177)
aagcttgccgccatgaggttctctgctcagcttctggggctgcttgtgctctggatccctggatccactgcagatattgtgatgacgca
ggctgcattctccaatccagtcactcttggaacatcagcttccatctcctgcaggtctagtaagagtctcctacatagtaatggcatca
cttatttgtattggtatctgcagaagccaggccagtctcctcagctcctgatttatcagatgtccaaccttgcctcaggagtcccagaca
ggttcagtagcagtgggtcaggaactgatttcacactgagaatcagcagagtggaggctgaggatgtgggtgtttattactgtgctc
aaaatctagaacttccgctcacgttcggtgctgggaccaagctggagctgaaacggggtggcggtggctcgggcggtggtgggt -continued cgggtggcggcggatcgtcacaggtgcagctgaagcagtcaggacctggcctagtgcagtcctcacagagcctgtccatcacct
gcacagtctctggtttctcattaactacctatgctgtacactgggttcgccagtctccaggaaagggtctggagtggctgggagtgat
atggagtggtggaatcacagactataatgcagctttcatatccagactgagcatcaccaaggacgcttccaagagccaagttttcttt
aaaatgaacagtctgcaacctaatgacagagccatttattactgtgccagaaatgggggtgataactaccttattactatgctatgga
ctactggggtcaaggaacctcagtcaccgtctcctctgatcagccagttccctcaactccacctacccccatctccctcaactccacct
acccccatctccctcatgctgccacccccgactgtcactgcaccgaccggccctcgaggacctgctcttaggttcagaagcgatcct
cacgtgcacactgaccggcctgagagatgcctcaggtgtcaccttcacctggacgccctcaagtgggaagagcgctgttcaagga
ccacctgaccgtgacctctgtggctgctacagcgtgtccagtgtcctgccgggctgtgccgagccatggaaccatgggaagacctt
cacttgcactgctgctaccccgagtccaagacccgctaaccgcaccctctcaaaatccgaaacacattccggcccgaggtc
cacctgctgccgccgccgtcggaggagctggccctgaacgagctggtgacgctgacgtgcctggcacgtggcttcagcccaa
ggatgtgctggttcgctggctgcaggggtcacaggagctgccccgcgagaagtacctgacttgggcatcccggcaggagccca
gccagggcaccaccaccttcgctgtgaccagcatactgcgcgtggcagccgaggactggaagaaggggg acaccttctcctgc
atggtgggccacgaggccctgccgctggccttcacacagaagaccatcgaccgcttggcgggtaaaccacccatgtcaatgtgt
ctgttgtcatggcggaggtggacgcggatccttcgaacaacctgctcccatcctgggccattaccttaatctcagtaaatggaattttt
gtgatatgctgcctgacctactgctttgccccaagatgcagagagagaaggaggaatgagagattgagaagggaaagtgtacgcc
ctgtataaatcgatac 5B9-IgAH IgA-T4-CD80 (amino acid sequence) (SEQ ID NO: 178)
MRFSAQLLGLLVLWIRGSTADIVMTQAAFSNPVTLGTSASISCRSSKSLLHSNGITY
LYWYLQKPGQSPQLLIYQMSNLASGVPDRFSSSGSGTDFTLRISRVEAEDVGVYYC
AQNLELPLTFGAGTKLELKRGGGSGGGGSGGGGSSQVQLKQSGPGLVQSSQSLS
ITCTVSGFSLTTYAVHWVRQSPGKGLEWLGVIWSGGITSYNAAFISRLSITKDDSK
SQVFFKMNSLQPNDTAIYYCARNGGDNYPYYYAMDYWGQGTSVTVSSDQPVPST
PPTPSPSTPPTPSPSCCHPPLSLHRPALEDLLLGSEAILTCTLTGLRDASGVTFTWTPS
SGKSAVQGPPDRDLCGCYSVSSVLPGCAEPWNHGKTFTCTAAYPESKTPLTATLS
KSGNTFRPEVHLLPPPSEELALNELVTLTCLARGFSPKDVLVRWLQGSQELPREKY
LTWASRQEPSQGTTIFAVTSILRVAAEDWKKGDTFSCMVGHEALPLAFTQKTIDR
LAGKPTHVNVSVVMAEVDADPSNNLLPSWAITLISVNGIFVVICCCTYCFAPRCRER
RRNERCRRESVRPV 5B9-scFv-human IgE Fc (CH2-CH3-CH4)-CD80 (nucleotide sequence) (SEQ ID NO: 179)
aagcttgccgccatgaggttctctgctcagct -continued

```
ccccatctccctcatgctgccaccccgactgtcactgcaccgaccggccctcgaggacctgctcttaggttcagaagcgatcctc
acgtgcacactgaccggcctgagagatgcctcaggtgtcaccttcacctggacgccctcaagtgggaagagcgctgttcaaggac
cacctgaccgtgacctctgtggctgctacagcgtgtccagtgtcctgccgggctgtgccgagccatggaaccatgggaagacctt
cacttgcactgctgcctaccccgagtccaagacccgctaaccgccaccctctcaaaatccggaaacacattccggcccgaggtcc
acctgctgccgccgccgtcggaggagctggccctgaacggctggtgacgctgcctggcacgtggcttcagccccaag
gatgtgctggttcgctggctgcaggggtcacaggagctgccccgcgagaagtacctgacttgggcatcccggcaggagcccag
ccagggcaccaccacctttcgctgtgaccagcatactgcgcgtggcagccgaggactggaagaaggggggacacttctcctgcat
ggtgggccacgaggccctgccgctggccttcacacagaagaccatcgaccgcttggcgggtaaacccacccatgtcaatgtgtct
gttgtcatggcggaggtggacgcggatccttcgaacaacctgctcccatcctgggccattaccttaatctcagtaaatggaattttttgt
gatatgctgcctgacctactgctttgccccaagatgcagagagagaaggaggaatgagagattgagaagggaaagtgtacgccct
gtataaatcgatac 2e12-scFv-IgAH IgA-T4-CD80 (amino acid sequence) (SEQ ID NO: 182)
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESSGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDQPVPS
TPPTPSPSTPPTPSPSCCHPRLSLHRPALEDLLLGSEAILTCTLTGLRDASGVTFTWTP
SSGKSAVQGPPDRDLCGCYSVSSVLPGCAEPWNHGKTFTCTAAYPESLTPLTATLS
KSGNTFRPEVHLLPPPSEELALNELVTLTCLATGFSPKDVLVRWLQGSQELPREKY
LTWASRQEPSQGTTTFAVTSILRVAAEDWKKGDTFSCMVGHEALPLAFTQKTIDR
LAGKPTHVNVSVVMAEVDADPSNNLLPSWAITLISVNGIFVICCLTYCFAPRCRER
RRNERLRRESVRPV 2e12-scFv-human IgE Fc (CH2-CH3-CH4)-CD80 (nucleotide sequence) (SEQ ID N -continued TDHYISWVKQKPGESLQWIGNVYGGNGGTSYNQKFQGKATLTVDKISSTAYMEL
SSLTSEDSAIYYCARRPVATGHAMDYWGQGIQVTVSSD NT
5' oligo:
Name    :IgGWT3 (SEQ ID NO: 187)
GTTGTTTTCGAAGGATCCGCTTTACCCGGAGACAGGGAGAGGCTCTT NT
3' oligo:
Name    :hIgGWT5 (SEQ ID NO: 188)
GTTGTTAGATCTGGAGCCCAAATCTTGTGACAAAACTCACACATG NT
5' oligo:
Name    :FADD5 (SEQ ID NO: 189)
Sequence
GTTGTGGATCCTTCGAACCCGTTCCTGGTGCTGCTGCACTCGGTGTCG NT
3' oligo:
Name    :FADD3 (SEQ ID NO: 190)
Sequence
GTTGTTATCGATCTCGAGTTATCAGGACGCTTCGGAGGTAGATGCGTC NT
FADD-CSSCFV (nucleotide sequence) (SEQ ID NO: 191)
gtggatccttcgaacccgttcctggtgctgctgcactcggtgtcgtccagcctgtcgagcagcgagctgaccgagctcaagttccta
tgcctcgggcgcgtgggcaagcgcaagctggagcgcgtgcagagcggcctagacctcttctccatgctgctggagcagaacga
cctggagcccgggcacaccgagctcctgcgcgagctgctcgcctccctgcggcgccacgacctgctgcgggcgcgtcgacgact
tcgaggcggggggcggcggccggggccgcgcctggggaagaagacctgtgtgcagcatttaacgtcatatgtgataatgtgggg
aaagattggagaaggctggctcgtcagctcaaagtctcagacaccaagatcgacagcatcgaggacagatacccccgcaacctg
acagagcgtgtgcgggagtcactgagaatctggaagaacacagagaaggagaacgcaacagtggcccacctggtgggggctc
tcaggtcctgccagatgaacctggtggctgacctggtacaagaggttcagcaggcccgtgacctccagaacaggagtggggcca
tgtccccgatgtcatggaactcagacgcatctacctccgaagcgtcctgataactcgagatcgataacaac FADD-CSSCFV (amino acid sequence) (SEQ ID NO: 192)
VDPSNPFLVLLHSVSSSLSSSELTELKFLCLGRVGKRKLERVQSGLDLFSMILLEQND
LEPGHTELLRELLASLRRHDLLRRVDDFEAGAAAGAAPGEEDLCAAFNVICDNVG
KDWRRLARQLKVSDTKIDSIEDRYPRNLTERVRESLRIWKNTEKENATVAHLVGA
LRSCQMNLVADLVQEVQQARDLQNRSGAMSPMSWNSDASTSEAS HCD28tm5B (nucleotide sequence) (SEQ ID NO: 193)
GTTGTGGATCCTCCCTTTTGGGTGCTGGTGGTGGTTGGTGTCCTGGCTTGCTAT
AGCTTG HCD28tm3S (nucleotide sequence) (SEQ ID NO: 194)
GTTGTYTCGAACCCAGAAAATAATAAAGGCCACTGTTACTAGCAAGCTATAGC
AAGCCAG HCD28tm5' (nucleotide sequence) (SEQ ID NO: 195)
GTTGTGGATCCTCCCTTTTGGGTGCTGGTGGT HCD28tm3' (nucleotide sequence) (SEQ ID NO: 196)
GTTGTTTCGAAGCCAGAAAATAATAAAGGCCAC HCD80tm5' (nucleotide sequence) (SEQ ID NO: 197)
GTTGTGGATCCTCCTGCTCCCATCCTGG HCD80tm3' (nucleotide sequence) (SEQ ID NO: 198)
GTTGTTTCGAACGGCAAAGCAGTAGGTCAGGC MFADD5BB (nucleotide sequence) (SEQ ID NO: 199)
GTGTGGATCCTTCGAACCCATTCCTGGTGCTGCTGCACTCGCTG MFADD3XC (nucleotide sequence) (SEQ ID NO: 200)
GTTGTTATCGATCTCGAGTGAGGGTGTTTCTGAGGAAGACAC Murine FADD nucleotide sequence (full length, but without flanking -Ig or
transmembrane sequences) (nucleotide sequence) (SEQ ID NO: 201)
gtggatccttcgaacatggacccattcctggtgctgctgcactcgctgtccggcagcctgtcggcaacgatctgatggagctcaa
gttcttgtgccgcgagcgcgtgagcaaacgaaagctggagcgcgtgcagagtggcctggacctgttcacggtgctgctggagca
gaccgacctggagcgcgggcacaccgagctcctgcgcgagttgctggcctcgctgcgccgacacgatctactgcagcgcctgg
acgacttcgaggcggggacggcgaccgctgcgcccccggggaggcagatctgcaggtggcattttgacattgtgtgtgacaatg
tggggagagactggaaaagactggcccgcgagctgaaggtgtctgaggccaagatggatgggattgaggagaagtaccccccg
aagtctgagtgagcgggtaaggagagtctgaaagtctggaagaatgctgagaagaagaacgcctcggtggccggactggtca
aggcgctgcggacctgcaggctgaatctggtggctgacctggtggaagaagcccaggaatctgtgagcaagagtgagaatatgt
ccccagtactaagggattcaactgtgtcttcctcagaaacaccctgactcgagatcgat Murine FADD (amino acid sequence) (SEQ ID NO: 202)
VDPSNMDPFLVLLHSLSGSLSGNDLMELKFLCRERVSKRKLERVQSGLDLFTVLLE
QNGLERGHTGLLRELLASLRHDLLQRLDDFEAGTATAAPPGEADLQVAFDIVCD
NVGRDWKRLARELKVSEAKMDGIEEKYPRSLSERVRESLKVWKNAEKKNASVA
GLVKALRTCRLNLVADLVEEAQESVSKSENMSPVLRDSTVSSSETP MCASP3-5 (nucleotide sequence) (SEQ ID NO: 203)
GTTGTGGATCCTTCGAACATGGAGAACAACAAAACCTCAGTGGATTCA MCASP3-3 (nucleotide sequence) (SEQ ID NO: 204)
GTTGTTATCGATCTCGAGCTAGTGATAAAAGTACAGTTCTTTGGT MCASP8-5 (nucleotide sequence) (SEQ ID NO: 205)
GTTGTTTCGAACATGGATTTCCAGAGTTGTCTTTATGCTATTGCTG MCASP8-3 (nucleotide sequence) (SEQ ID NO: 206)
GTTGTTATCGATGTCGAGTCATTAGGGAGGGAAGAAGAGCTTCTTCCG hcasp3-5 (nucleotide sequence) (SEQ ID NO: 207)
GTTGTGGATCCTTCCAACATGGAGAACACTGAAAACTCAGTGGAT hcasp3-3 (nucleotide sequence) (SEQ ID NO: 208)
GTTGTTATCGATCTCGAGTTAGTGATAAAAATAGAGTTCTTTTGTGAG hcasp8-5 (nucleotide sequence) (SEQ ID NO: 209)
GTTGTGGATCCTTCGAACATGGACTTCAGCAGAAATCTTTATGAT hcasp8-3 (nucleotide sequence) (SEQ ID NO: 210)
GTTGTTATCGATGCATGCTCAATCAGAAGGGAAGACAAGTTTTTTTCT 1. 2H7 scFv with alternative VHL11 mutations (SEQ ID NO: 211):
Nucleotide sequence
Aagcttgccgccatggattttcaaggtgcagattttcagcttcctgctaatcagtgcttcagtcataattgccagaggacaaattgttctc
tcccagtctccagcaatcctgtctgcatctccaggggagaaggtcacaatgacttgcagggccagctcaagtgtaagttacatgcac
tggtaccagcagaagccaggatcctcccccaaaccctggatttatgcccatccaacctggcttctggagtccctgctcgcttcagt
ggcagtgggtctgggacctcttactctctcacaatcagcagagtggaggctgaagatgctgccacttattactgccagcagtggagt
tttaacccacccacgttcggtgctgggaccaagctggagctgaaagatggcggtggctcgggcggtggtggatctggaggaggt
gggagctctcaggcttatctacagcagtctggggctgag (one of the following: tcn, acn, gan, can, aan,
cgn, agn)
gtgaggcctggggcctcagtgaagatgtcctgcaaggcttctggctacacatttaccagttacaatatgcactgggttaaagcagaca
cctagacagggcctggaatggattggagctatttatccaggaaatggtgatacttcctacaatcagaagttcaagggcaaggccac
actgactgtagacaaatcctccagcacagcctacatgcagctcagcagcctgacatctgaagactctgcggtctatttctgtgcaag
agtggtgtactatagtaactcttactggtactttcgatgtctggggcacagggaccacggtcaccgtctcttctgatcag Amino acid sequence (SEQ ID NO: 212)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAE (one of the following:
S, T, D, E, Q, N, R, K, H)
VRPGASVKMSCKASGYIFTSYNMHWVKQTPRQGLEWIGAIYFGNGDTSYNQKFK
GKATLTVDKSSSTAYMQLSSLTSEDSAVYFCARVVYYSNSYWYFDVWGTGTTVT
VSSDQ 2. VHL11 deletion (SEQ ID NO: 213)
Nucleotide sequence:
Aagcttgccgccatggattttcaagtgcagattttcagcttcctgctaatcagtgcttcagtcataattgccagaggacaaattgttctc
tcccagtctccagcaatcctgtctgcatctccaggggagaaggtcacaatgacttgcagggccagctcaagtgtaagttacatgcac
tggtaccagcagaagccaggatcctcccccaaaccctggatttatgcccatccaacctggcttctggagtccctgctcgcttcagt
ggcagtgggtctgggacctcttactctctcacaatcagcagagtggaggctgaagatgctgccacttattactgccagcagtggagt
tttaacccacccacgttcggtgctgggaccaagctggagctgaaagatggcggtggctcgggcggtggtggatctggaggaggt
gggagctctcaggcttatctacagcagtctggggctgaggtgaggcctggggcctcagtgaagatgtcctgcaaggcttctggct
acacatttaccagttacaatatgcactgggtaaagcagacacctagacagggcctggaatggattggagctatttatccaggaaatg
gtgatacttcctacaatcagaagttcaagggcaagggcaaggccacactgactgtagacaaatcctccagcacagcctacatgcagctcagc
agcctgacatctgaagactcgcggtctatttctgtgcaagagtggtgtactatagtaactcttactggtacttcgatgtctggggcaca
gggaccacggtcaccgtctcttctgatcag Amino acid sequence (SEQ ID NO:214):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAEVRPGASVKMSCKA
SGYTFTSYNMHWVKQTFRQGLEWIGAIYPGNGDTSYNQKFKGKATLTVDKSSST
AYMQLSSLTSEDSAVYFCARVVYYSNSYWYFDVWGTGTTVTVSSDQ 3. 2H7 VL L106 with alternative mutations
Nucleotide sequence (SEQ ID NO:215):
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt -continued taacccacccacgttcggtgctgggaccaagctggag (tcn, agn, aan, cgn, gan, and non-natural derivatives of these codons) aaagatggcggtggctcgggcggtggtggatctggaggaggtgggagctc Amino acid sequence (SEQ ID NO: 216):
MDFQVQIFSFLLISASVIIARGQIVLSQSPAILSASPGEKVTMTCRASSSVSYMHWY
QQKPGSSPKPWIYAPSNLASGVPARFSGSGSGTSYSLITISRVEAEDAATYYCQQWS
FNPPTFGAGTKLE (S, T, R, K, H, Q, N, D, E, and non-natural derivatives of these
amino acids at position 106) KDGGGSGGGGSGGGGSS 4. VL L106 deletion (SEQ ID NO: 217)
Nucleotide sequence:
Aagcttgccgccatggattttcaagagcagattttcagcttcctgctaatcagtgcttcagtcataattgccagaggacaaattgttctc
tcccagtctccagcaatcctgtctgcatctccaggggagaaggtcacaatgacttgcagggccagctccagctcaagtgtaagttacatgcac
tggtaccagcagaaagccaggatcctcccccaaaccctggatttatgcccatccaacctggcttctggagtccctgctcgcttcagt
ggcagtgggtctgggacctcttactctctcacaatcagcagagtggaggctgaagatgctgccacttattactgccagcagtggagt
tttaacccacccacgttcggtgctgggaccaagctggagaaagatggcggtggctcgggcggtggtggatctggaggaggtgg
gagctc Amino acid sequence: (SEQ ID NO: 218)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLEKDGGGSGGGGSGGGGSS 5. IgE CH3 CH4 (SEQ ID NO: 219)
Nucleotide sequence:
tccaacccgagagggtgagcgcctacctaagccggcccagcccgttcgacctgttcatccgcaagtcgcccacgatcacctgtc
tggtggtggacctggcacccagcaaggggaccgtgaacctgacctggtcccgggccagtgggaagcctgtgaaccactccacc
agaaaggaggagaagcagcgcaatggcacgttaaccgtcacgtccaccctgccggtgggcacccgagactggatcgaggggg
agacctaccagtgcagggtgacccaccccacctgcccagggccctcatgcggtccacgaccaagaccagcggcccgcgtgct
gccccggaagtctatgcgtttgcgacgccggagtggccggggagccgggacaagcgcaccctcgcctgcctgatccagaactt
catgcctgaggacatctcggtgcagtggctgcacaacgaggtgcagctcccggacgcccggcacagcacgacgcagcccgc
aagaccaagggctccggcttcttcgtcttcagccgcctggaggtgaccagggccgaatgggagcagaaagatgagttcatctgcc
gtgcagtccatgaggcagcgagcccctcacagaccgtccagcgagcggtgtctgtaaatcccggtaaatgataatctagaa Amino acid sequence (SEQ ID NO: 220):
SNPRGVSAYLSRPSPFDLFIRKSPTITCLVVDLAPSKGTVNLTWSRASGKPVNHSTR
KEEKQRNGTLTVTSTLPVGTRDWIEGTEYQCRVTHPHLPRALMRSTTKTSGPRAA
PEVYAFATPEWPGSRDKRTLACLIQNFMPEDISVQWLHNEVQLPDARHSTTQPRK
TKGSGFFVFSRLEVTRAEWEQKDEFICRAVHEAASPSQTVQRAVSVNPGK 6. hIgG1H/IgE WCH3 WCH4 (SEQ ID NO:221)
Nucleotide sequence:
tgatcaggagcccaaatcttctgacaaaactcacacatccccaccgtcccagcatccaacccgagagggtgagcgcctaccta
agccggcccagcccgttcgacctgttcatccgcaagtcgcccacgatcacctgtctggtggtggacctggcacccagcaagggg
accgtgaacctgacctggtcccgggccagtgggaagcctgtgaaccactccaccagaaaggaggagcagcagcgcaatggca
cgttaaccgtcacgtccaccctgccggtgggcacccgagactggatcgaggggagacctaccagtgcagggtgacccaccc
cacctgcccagggccctcacgcggtccacgaccaagaccagcggcccgcgtgctgccccggaagtctatgcgttgcgacgcc
ggagtggccggggagccgggacaagcccaccctcgcctgcctgatccagaacttcatgcctgaggacatctcggtgcagtggct
gcacaacgaggtgcagctcccggacgcccggcacagcacgacgcagcccgcaagaccaagggctccggcttcttcgtcttca
gccgcctggaggtgaccagggccgaatgggagcagaaagatgagttcatctgccgtgcagtccatgaggcagcgagcccctca
cagaccgtccagcgagcggtgtctgtaaatcccggtaaatgataatctagaa Amino acid sequence (SEQ ID NO:222):
DQEPKSSDKTHTSPPSFASSNPRGVSAYLSRPSPFDLFIRKSPTITCLVVDLAPSKGTV
NLTWSRASGKPVNHSTRKEEKQRNGTLTVTSTLPVGTRDWIEGETYQCRVTHPHL
PRALMRSTTKTSGPRAAPEVYAFATPEWPGSRDKRTLACLIQNFMPEDISVQWLH
NEVQLPDARHSTTQPRKTKGSGFFVFSRLEVTRAEWEQKDEFICRAVHEAASPSQT
VQRAVSVNGK 7. IgE WCH2 WCH3 WCH4 (SEQ ID NO: 223)
Nucleotide sequence:
Tgatcacgtctgctccaggacttcacccgcccaccgtgaagatcttacagtcgtcctgcgacggcggcggcacttcccccg
accatccagctcctgtgcctcgtctctctgggtacaccccagggactatcaacatcacctggctggaggacgggcaggtcatgacg
tggacttgtccaccgctctaccacgcaggagggtgagctggcctccacacaaagcgagctcaccctcagccagaagcactggc
tgtcagaccgcacctacacctgccaggtcacctatcaaggtcacacctttgaggacagcaccaagaagtgtgcagattccaaccc
gagagggtgagcgcctacctaagccggcccagcccgttcgacctgttcatccgcaagtcgcccacgatcacctgtctggtggtg
gacctggcacccagcaaggggaccgtgaacctgacctggtcccgggccagtgggaagcctgtgaaccactccaccagaaagg
aggagaagcagcgcaatggcacgttaaccgtcacgtccaccctgccggtgggcacccgagactggatcgaggggagaccta
ccagtgcagggtgacccaccccacctgcccagggccctcatgcggtccacgaccaagaccagcggcccgcgtgctgcccccg
gaagtctatgcgtttgcgacgccggagtggccggggagccgggacaagcgcaccctcgcctgcctgatccagaacttcatgcct
gaggacatctcggtgcagtggctgcacaacgaggtgcagctcccggacgcccggcacagcacgacgcagcccgcaagacc
aagggctccggcttcttcgtcttcagccgcctggaggtgaccagggccgaatgggagcagaaagatgagttcatctgccgtgcag
tccatgaggcagcgagcccctcacagaccgtccagcgagcggtgtctgtaaatcccggtaaatgataatctaga Amino acid sequence (SEQ ID NO: 224):
DHVCSRDFTPPTVKILQSSCDGGGHFPPTIQLLCLVSGYTPGTINITWLEDGQVMDV
DLSTASTTQEGELASTWSELTLSQKHWLSDRTYTCQVTYQGHTFEDSTKKCADSN
PRGVSAYLSRPSPFDLFIRKSPTITCLVVDLAPSKGTVNLTWSRASGKPVNHSTRKE
EKQRNGTLTVTSTLPVDTRDWIEGETYQCRVTHPHLPRALMRSTTKTSGPRAAPE VYAFATPEWPGSRDKRTLACLIQNFMPEDISVQWLHNEVQLPDARHSTTQPRKTK
GSGFFVFSRLEVTRAEWEQKDEFICRAVHEAASPSQTVQRAVSNPGK 8. hIgG1H/IgE CH3 CH4 (ORF) (SEQ ID NO: 225)
Nucleotide sequence:
tgatcaggagcccaaatcttctgacaaaactcacacatccccaccgtccccagcatccaacccgagagggtgagcgcctaccta
agccggcccagcccgttcgacctgttcatccgcaagtcgcccacgatcacctgtctggtggtggacctggcacccagcaagggg
accgtgaacctgacctggtcccgggccagtgggaagcctgtgaaccactccaccagaaaggaggaaaagcagcgcaatggca
cgttaaccgtcacgtccaccctgccggtgggcacccgagactggatcgagggggagacctaccagtgcagggtgacccaccce
cacctgcccagggccctcatgcggttccacgaccaagaccagcggcccgcgtgctgcccggaagtctatgcgtttgcgacgcc
ggagtggccggggagccgggacaagcgcaccctcgcctgcctgatccagaacttcatgcctgaggacatctcggtgcagtggct
gcacaacgaggtgcagctcccggacgcccggcacagcacgacgcagcccgcaagaccaagggctccggcttcttcgtcttca
gccgcctggaggtgaccagggccgaatgggagcagaaagatgagttcatctgccgtgcagtccatgaggcagcgagcccctca
cagaccgtccagcgagcggtgtctgtaaatcccggtaaagcggatccttcgaa Amino acid sequence (SEQ ID NO: 226):
DQEPKSSDKTHTSPPSPASNPRGVSAYLSRPSPFDLFIRKSPTITCLVVDLAPSKGTV
NLTWSRASGKPPVNHSTRKEFKQRNGTLTVTSTLPVGTRDWIEGETYQCRVTHPHL
PRALMRSTTKTSGPRAAPEVYAFATPEWPGSRDKRTLACLIQNFMPEDISVQWLH
NEVQLPDARHSTTQPKKTKGSGFFVFSRLEVTRAEWEGQKDEFICRAVHEAASPSQT
VQRAVSVNPGKSGSFE 9. 2H7 VHL11S scFv hIgG1(SSS-S)H hIgE WCH3 WCH4 (SEQ ID NO: 227)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcgtggtggatctgaggaggtg
ggagctctcaggcttatctacagcagtctggggctgagtcggtgaggcctggggctccagtgaagatgtcctgcaaggcttctggc
tacacatttaccagttacaatatgcactgggtaaagcagacacctagacaggcctggatggattggagctatttatccaggaaat
ggtgatacttcctacaatcagaagttcaaggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcatccaacc
cgagaggggtgagcgcctaccaagccggcccagcccgttcgacctgttcatccgcaagtcgcccacgatcacctgtctggtggt
ggacctggcacccagcaaggggaccgtgaacctgacctggtcccgggccagtgggaagcctgtgaaccactccaccagaaag
gaggagaagcagcgcaatggcacgttaaccgtcacgtccaccctgccggtgggcacccgagactggatcgagggggagacct
accagtgcagggtgacccacccccacctgcccagggccctcatgcggttccacgaccaagaccagcggcccgcgtgctgccc
ggaagtctatgcgtttgcgacgccggagtggccggggagccgggacaagcgcaccctcgcctgcctgatccagaacttcatgcc
tgaggacatctcggtgcagtggctgcacaacgaggtgcagctcccggacgcccggcacagcacgacgcagcccgcaagacc
aagggctccggcttcttcgtcttcagccgcctggaggtgaccagggccgaatgggagcagaaagatgagttcatctgccgtgcag
tccatgaggcagcgagcccctcacagaccgtccagcgagcggtgtctgtaaatcccggtaaatgataatctaga Amino acid sequence (SEQ ID NO: 228):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYYPGNGDTSYNQKGKATLTVDKSSS
TAYMQLSSLTSEDSAVYFCARVVYYSNSYWYFDVWGTGTTVTVSSDQEPKSSDK
THTSPPSSASNPRGVSAYLSRPSPFDLFIRKSPTITCLVVDLAPSKGTVNLTWSRASG
KPVNHSTRKEEKQRNGTLTVTSTLPVGTRDWIEGETYQCRVTHPHLPRALMRSTT
KTSGPRAAPEVYAFATPEWPGSRDKRTLACLIQNFMPEDISVQWLHNEVQLPDAR
HSTTQPRKTKGSGFFVFSRLEVTRAEWEQKDEFICRAVHEAASPSQTVQRAVSVNP
GK 10. 2H7 VHL11S scFv hIgG1(SSS-P)H hIgE WCH3 WCH4 (SEQ ID NO: 229)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcgtggtggatctgaggaggtg
ggagctctcaggcttatctacagcagtctggggctgagtcggtgaggcctggggctccagtgaagatgtcctgcaaggcttctggc
tacacatttaccagttacaatatgcactgggtaaagcagggcctggaatggattggagctatttatccaggaaat
ggtgatacttcctacaatcagaagttcaaggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcccagcatccaacc
cgagaggggtgagcgcctaccaagccggcccagcccgttcgacctgttcatccgcaagtcgcccacgatcacctgtctggtggt
ggacctggcacccagcaaggggaccgtgaacctgacctggtcccgggccagtgggaagcctgtgaaccactccaccagaaag
gaggagaagcagcgcaatggcacgttaaccgtcacgtccaccctgccggtgggcacccgagactggatcgagggggagacct
accagtgcagggtgacccacccccacctgcccagggccctcatgcggttccacgaccaagaccagcggcccgcgtgctgccc
ggaagtctatgcgtttgcgacgccggagtggccggggagccgggacaagcgcaccctcgcctgcctgatccagaacttcatgcc
tgaggacatctcggtgcagtggctgcacaacgaggtgcagctcccggacgcccggcacagcacgacgcagcccgcaagacc
aagggctccggcttcttcgtcttcagccgcctggaggtgaccagggccgaatgggagcagaaagatgagttcatctgccgtgcag
tccatgaggcagcgagcccctcacagaccgtccagcgagcggtgtctgtctgtaaatcccggtaaatgataacctaga Amino acid sequence (SEQ ID NO: 230):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK -continued ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSPASNPRGVAYLSRPSPFDLFIRKSPTITCLVVDLAPSKGTVNLTWSRASG
KPVNHSTRKEEKQRNGTLTVTSTLPVGTRDWIEGETYQCRVTHPHLPRALMRSTT
KTSGPRAAPEVYAFATPEWPGSRDKRTLACLIQNFMPEDISVQWLHNEVQLPDAR
HSTTQPRKTKGSGFFVFGRLEVTRAEWEQKDEFICRAVHEAASPSQTVQRAVSVNP
GK 10. 2H7 VL L106S (SEQ ID NO: 231)
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagctgaaagatggcggtggctcggggcggtggtggatctggaggaggtg
ggagctc Amino acid sequence (SEQ ID NO: 232):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLESKDGGGSGGGGSGGGGSS 11. 2H7 VL L106S scFv (SEQ ID NO: 233)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagtctaaagatggcggtggctcggggcggtggtggatctggaggaggtg
ggagctctcaggcttatctacagcagtctggggctgagctggtgaggcctggggcctcagtgaagatgtcctgcaaggcttctggc
tacacatttaccagttacaatatgcactgggtaaagcagacacctagacaggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcag Amino acid sequence (SEQ ID NO: 234):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLESKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQ 12. 2H7 scFv VL L106S VHL11S scFv (SEQ ID NO: 235)
Nucleotide sequence:
Aagcttgccgccatggattttcaagtgcagattttcagcttcctgctaatcagtgcttcagtcataattgccagaggacaaattgttctc
tcccagtctccagcaatcctgtctgcatctccaggggagaaggtcacaatgacttgcagggccagctcaagtgtaagttacatgcac
tggtaccagcagaagccaggatcctcccccaaaccctggatttatgcccatccaacctggcttctggagtccctgctcgcttcagt
ggcagtgggtctgggacctcttactctctcacaatcagcgagtggaggctgaagatgctgccacttattactgccagcagtggagt
tttaacccacccacgttcggtgctgggaccaagctggagtctaaagatggcggtggctcggggcggtggtggatctggaggaggt
gggagctctcaggcttatctacagcagtctggggctgagtcggtgaggcctggggcctcagtgaagatgtcctgcaaggcttctg
gctacacatttaccagttacaatatgcactgggtaaagcagacacctagacaggcctggaatggattggagctatttatccaggaa
atggtgatacttcctacaatcagaagttcaagggcaaggccacactgactgtagacaaatcctccagcacagcctacatgcagctc
agcagcctgacatctgaagactctgcggtctatttctgtgcaagagtggtgtactatagtaactcttactggtacttcgatgtctgggc
acagggaccacggtcaccgtctcttctgatcag Amino acid sequence (SEQ ID NO: 236):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLASKDGGGSGGGGSGGGGSSQAYLQQSGAELVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQ 10. Human IgD hinge linker with attached restriction sites (SEQ ID NO: 237)
Nucleotide:
gtggatccaggttcgaagtctccaaaggcacaggcctcctccgtgcccactgcacaaccccaagcagagggcagcctcgccaa
ggcaaccacagcccagccaccacccgtaacacaggaagaggaggaagagaagaagaaggagaaggagaaagaggaa
caagaagagagagagacaaagaccggtgcagtcgacg Amino acid (SEQ ID NO: 238):
VDPGSKSPKAQASSVPTAQPAEGSLAKATTAPATTRNTGRGGEEKKKEKEKEEQ
EERETKTGAVD Sequence of Native IgD hinge domain (SEQ ID NO: 239):
(includes a cysteine residue-we truncated the hinge prior to that residue for these
constructs:)
Nucleotide:
gagtctccaaaggcacaggcctcctccgtgcccactgcacaaccccaagcagagggcagcctcgccaaggcaaccacagccc
cagccaccacccgtaacacaggaagaggaggagaagagaagaagaaggagaaggagaaagaggaacaagaagagaga
gacaaagacaccagagtgtccgagccacacccagcctcttggcgtctacctgctaaccccct Amino acid sequence (SEQ ID NO: 240):
ESPKAQASSVPTAQPQAEGSLAKATTAPATTRNTGRGGEEKKKEKEKEEQEERET
KTPECPSHTQPLGVYLLTP 12. 2H7 VH L11S (SEQ ID NO: 241)
Nucleotide sequence:
caggcttatctacagcagtctggggctgagtcggtgaggcctggggcctcagtgaagatgtcctgcaaggcttctggctacacattt
accagttacaatatgcactgggtaaagcagacacctagacagggcctggaatggattggagctatttatccaggaaatggtgatact
tcctacaatcagaagttcaagggcaaggccacactgactgtagacaaatcctccagcacagcctacatgcagctcagcagcctga
catctgaagactctgcggtctatttctgtgcaagagtggtgtactatagtaactcttactggtacttcgatgtctggggcacagggacc
acggtcaccgtctcttct Amino acid sequence (SEQ ID NO: 242):
QAYLQQSGAESVRPGASVKMSCKASGYTFTSYNMHWVKQTPRQGLEWIGAIYPG
NGDTSYNQKFKGKATLTVDKSSSTAYMQLSSLTSEDSAVYFCARVVYYSNSYWY
FDVWGTGTTVTVSS 13. 2H7 VH L11S scFv (SEQ ID NO: 243)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctgaggaggtg
ggagctctcaggcttatctacagcagtctggggctgagtctgtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctgggcac
agggaccacggtcaccgtctcttctgatcag Amino acid sequence (SEQ ID NO: 244):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQ 14. 2H7 scFv VH L11S hIgG1 (CSC-S)H WCH2 WCH3 (SEQ ID NO: 245)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctgaggaggtg
ggagctctcaggcttatctacagcagtctggggctgagtctgtgaggcctggggcctcagtgaagatgtcctgcaaggcttctggct
acacatttaccagttacaatatgcactgggtaaagcagacacctagacagggcctggaatggattggagctatttatccaggaaatg
gtgatacttcctacaatcagaagttcaagggcaaggccacactgactgtagacaaatcctccagcacagcctacatgcagctcagc
agcctgacatctgaagactctgcggtctatttctgtgcaagagtggtgtactatagtaactcttactggtacttcgatgtctgggcaca
gggaccacggtcaccgtctcttctgatcaggagcccaaatcttgtgacaaaactcacacatctccaccgtgctcagcacctgaactc
ctgggtggaccgtcagtcttcctcttccccccaaaacccaaggacaccctcatgatctcccgaccccctgaggtcacatgcgtggt
ggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 246):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDK
THTSPPCSAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 15. 2H7 scFv VH L11S IgE WCH2 WCH3 WCH4 (SEQ ID NO: 247)
Nucleotide sequence:
aagctgccgccatggattttcaagagcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactccctcacaatcagcagagtggaggctgaagatgctgccacttattactgccagcagtggagttt
taacccaccccacgttcggtgctgggaccaagctggagctgaaagatggcggtggctcggcggtggtggatctgaggaggtg
ggagctctcaggcttatctacagcagtctggggctgagtctgtgaggcctggggcctcagtgaagatgtcctgcaaggcttctggct
acacatttaccagttacaatatgcactgggtaaagcagacacctagacagggcctggaatggattggagctatttatccaggaaatg -continued
gtgatacttcctacaatcagaagttcaagggcaaggccacactgactgtagacaaatcctccagcacagcctacatgcagctcagc
agcctgacatctgaagactctgcggctaattctgtgcaagagtggtgtactatagtaactctcactggtacttcgatgtctgggcaca
gggaccacggtcaccgtctcttctgatcacgtcgctccagggacttcaccccgcccaccgtgaagatcttacagtcgtcctgcgac
ggcggcgggcacttcccccgaccatccagctccgtgcctcgtctctgggtacaccccagggactatcaacatcacctggctgg
aggacgggcaggtcatggacgtggacttgtccaccgcctctaccacgcaggagggtgagcgtggcctccacacaaagcgagctc
accctcagccagaagcactggctgtcagaccgcacctacacctgccaggtcacctatcaagtgtcacaccttttgaggacagcacca
agaagtgtgcagattccaacccgagaggggtgagcgcctacctaagccggcccagccccgttcgacctgttcatccgcaagtcgc
ccacgatcacctgtctggtggtggacctggcacccagcaaggggaccgtgaacctgacctggtcccgggccagtgggaagcct
gtgaaccactccaccagaaggaggagaagcagcgcaatggcagcgttaaccgtcacgtccaccctgccggtgggcacccgag
actggatcgaggggggagacctaccagtgcagggtgacccaccccacctgcccagggccctcatgcggtccacgaccaagac
cagcggcccgcgtgctgccccggaagtctatgcgtttgcgacgccggagtggcggggagccgggacaagcgcaccctcgcc
tgcctgatccagaacttcatgcctgaggacatctcggtgcagtggctgcacaacgaggtgcagctcccggacgcccggcacagc
acgacgcagccccgcaagaccaagggctccggcttcttcgtcttcagccgcctggaggtgaccagggccgaatgggagcagaa
agatgagttcatctgccgtgcagtccatgaggcagcgagcccctcacagaccgtccagcgagcggtgtctgtaaatcccggtaaa
tgataatctaga Amino acid sequence (SEQ ID NO: 248):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKCGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDHVCSRDFT
PPTVKILQSSCDGGGHFPPTIQLLCLVSGYTPGTINITWLEDGQVMDVDLSTASTTQ
EGELASTQSELTLSQKHWLSDRTYTCQVTYQGHTFEDSTKKCADSNPRGVSAYLS
RPSPFDLFIRKSPTITCLVVDLAPSKGTVNLTWSRASGKPVNHSTRKEEKQRNGTLT
VTSTLPVGTRDWIEGETYQCRVTHPHLPRALMRSTTKTSGPRAAPEVYAFATPEW
PGSRDKRTALCLIQNFMPEDISVQWLHNEVQLPDARHSTTQPRKTKGSGFFVFSRL
EVTRAEWEQKDEFICRAVHEAASPSQTVQRAVSVNPGK 16. 2H7 scFv VH L11S mIgE WCH2 WCH3 WCH4 (SEQ ID NO: 249)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctggggctgagtctgtgaggcctggggcctcagtgaagatgtcctgcaaggcttctggct
acacatttaccagttacaatatgcactgggtaaagcagacacctagacagggcctggaatggattggagctatttatccaggaaatg
gtgatacttcctacaatcagaagttcaagggcaaggccacactgactgtagacaaatcctccagcacagcctacatgcagctcagc
agcctgacatctgaagactctgcggtctatactgtgcaagagtggtgtactatagtaactcttactggtactcgatgtctgggcaca
gggaccacggtcaccgtctcttctgatcacgttcgacctgtcaacatcactgagcccaccttggagctactccattcatcctgcgacc
ccaatgcattccactccaccatccagctgtactgcttcatttatggccacatcctaaatgatgtctctgtcagctggctaatggacgatc
gggagataactgatacacttgcacaaactgttctaatcaaggaggaaggcaaactagcctctacctgcagtaaactcaatactcactg
agcagcaatggatgtctgaaagctccttcacctgcacggtcacctcccaaggcgtagactcttggcccacactcggagatgccca
gatcatgagccacggggtgtgattacaacctgatcccacccagcccctggacctgtatcaaaacggtgctcccaagcttacctgt
ctggtggtggacctggaaagcgagaagaatgtcaatgtgactggaaccaagaagaagacttcagcctcagcatcccagtggt
acactaagcaccacaataacgcccacaactagtatcacctccatcctgcctgtagttgccaaggactggattgaaggctacggctatc
agtgcatagtggaccacacctgatttttcccaagcccattgtgcgttccatcaccaagacccccaggccagcgctcagccccgaggta
tatgtgttccaccaccagaggcggagagcgaggacaaacgcacactcacctgttttgatccagaacttcttccctgaggatatctct
gtgcagtggctggggatgcaaactgaactcaaacagccagcacagtaccacaacacccctgaaatccaatggctccaatcaa
ggcttcttcatcttcagtcgcctagaggtcgccagacactctggacacagagaaaacagttcacctgccaagtgatccatgaggc
acttcagaaacccaggaaactggagaaaacaatatccacaagccttggtaacacctccctccgtccatcctagtaatctagag Amino acid sequence (SEQ ID NO: 250):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDHVRPVNIT
EPTLELLHSSCDPNSFHSTIQLYCFIYGHILNDVSVSWLMDDREITDTLAQTVLIKE
EGKLASTCSKLNITEQQWMSESTFTCKVTSQGVDYLAHTRRCPDHEPRGVITYLIP
PSPLDLYQNGAPKLTCLVVDLESEKNVNVTWNQEKKTSVSASQWYTKHHNNATT
SITSILPVVAKDWIEGYGYQCIVDHPDFPKPIVRSITKTPGQRSAPEVYVFPPPEEESE
DKRTLTCLIQNFFPEDISVQWLGDGKLISNSQHSTTTPLKSNGSNQGFFIFSRLEVAK
TLWTQRKQFTCQVIHEALQKPRKLEKTISTSLGNTSLRPS 17. 2H7 scFv VH L11S hIgA WH WCH2 T4CH3 (SEQ ID NO: 251)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcgggcggtggtggatctgaggaggtg
ggagctctcaggcttatctacagcagtctggggctgagtctgtgaggcctggggcctcagtgaagatgtcctgcaaggcttctggct
acacatttaccagttacaatatgcactgggtaaagcagacacctagacagggcctggaatggattggagctatttatccaggaaatg
gtgatacttcctacaatcagaagttcaagggcaaggccacactgactgtagacaaatcctccagcacagcctacatgcagctcagc
agcctgacatctgaagactctgcggtctatttctgtgcaagagtggtgtactatagtaactcttactggtacttcgatgtctgggcaca
gggaccacggtcaccgtctcttctgatcagccagttcccaactccacctaccccatctccctcaactccacctaccccatctccct
catgctgccaccccgactgtcactgcaccgaccggccctcgaggaccgctcttaggttcagaagcgatcctcacgtgcacactg
accggcctgagagatgcctcaggtgtcaccttcacctggacgcccctcaagtgggaagagcgctgttcaaggaccacctgaccgtg -continued acctctgtggctgctacagcgtgtccagtgtcctgccgggctgtgccgagccatggaaccatgggaagaccttcacttgcactgct
gcctaccccgagtccaagacccgctaaccgccacccctctcaaaatccggaaacacattccggcccgaggtccacctgctgccg
ccgccgtcggaggagctggccctgaacgagctggtgacgctgacgtgcctggcacgtggcttcagccccaaggatgtgctggtt
cgctggctgcaggggtcacaggagctgccccgcgagaagtacctgacttgggcatcccggcaggagcccagccagggcacca
ccaccttcgctgtgaccagcatactgcgcgtggcagccgaggactggaagaaggggggacaccttctcctgcatggtgggccacg
aggccctgccgctggccttcacacagaagaccatcgaccgcttggcgggtaaacccacccatgtcaatgtgtctgttgtcatggcg
gaggtggactgataatctaga Amino acid sequence (SEQ ID NO: 252):
MDFQVQIFSFLLISASVIIARGQIVOLLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTTVTVSSDQPVPSTPPT
PSPSTPPTPSPSCCHPRLSLHPPALEDLLLGSSEAILTCTLTGLRDASGVTFTWTPSSG
KSAVQGPPDRDLCGCYSVSSVLPGCAEPWNHGKTFTCTAAYPESKTPLTATLSKS
GNTFRPEVHLLPPPSEELALNELVTLTCLARGFSPKDVLVRWLQGSQELPREKYLT
WASRQEPSQGTTTFAVTSILRVAAEDWKKGDTFSCMVGHEALPLAFTQKTIDRLA
GKPTHVNVSVVMAEVD 18. 2H7 scFv VH L11S mIgA WH WCH2 T4 CH3 (SEQ ID NO: 253)
Nucleotide sequence:
aagcttgccgccatggatttcaagtgcagatttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatccccacccctggatttatgcccatccaacctggcttctggagtccctgctcgcttcagtg
gcagtgggtctgggacctcttactctctcaccatcagcagagtggaggctgaagatgctgccactattaacgccagcagtggagttt
taacccacccacgttcggagctgggaccaagctggagctgaaagatggcggtggctcgggcggtggtgatcggaggaggtg
ggagctctcaggcttacctacagcagtctggggctgagtctgtgaggcctggggcctcagtgaagatgtcctgcaaggcttctggct
acacatttaccagttacaatatgcactgggtaaagcagacacctagacagggcctggaatggattggagctatttatccaggaaatg
gtgatacttcctacaatcagaagttcaagggcaaggccacagtcactgtagacaaatcctccagcacagcctacatgcagctcagc
agcctgacatctgaagactctgcggtctatttctgtgcaagagtggtgtactatagtaactcttactggtacttcgatgtctggggcaca
gggaccacggtcaccgtctcttctgatcacatctgttctcctcctactactcctcctccaccttcctgccagcccagcctgtcactgca
gcggccagctcttgaggacctgctcctgggttcagatgccagcatcacatgtactctgaatggcctgagagatcctgagggagctg
tcttcacctgggagccctccactgggaaggatgcagtgcagaagaaagctgtgcagaattcctgcggctgctacagtgtgtccagc
gtcctgcctggctgtgctgagcgctggaacagtggcgcatcattcaagtgcacagttaccatcctgagtctgacaccttaactggc
acaattgccaaagtcacagtgaacaccttcccacccaggtccacctgctaccgccgccgtcggaggagctggccctgaatgag
ctcgtgtccctgacatgcctggtgcgagcttcaaccctaaagaagtgctggtgcgatggctgcatggaaatgaggagctgtcccc
agaaagctacctagtgtttgagcccctaaaggagccaggcgaggagccaccacctacctggtgacaagcgtgttgcgtgtataca
gctgaaatctggaaacaggtgaccagtactcctgcatggtgggccacgaggccttgcccatgaacttcacccagaagaccatcg
accgtctgtcgggtaaacccaccaatgtcagcgtgtctgtgatcatgtcagagggagattgataatctagat Amino acid sequence (SEQ ID NO: 254):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTTVTVSSDHICSPPTTP
PPPSCQPSLSLQRPALEDLLLGSDASITCTLNGLRDPEGAVFTWEPSTGKDAVQKK
AVQNSCGCYSVSSVLPGCAERWNSGASFKCTVTHPESDTLTGTIAKVTVNTFPPQV
HLLPPPSEELALNELVSLTCLVRAFNPKEVLVRWLHGNEELSPESYLVFEPLKEPGE
GATTYLVTSVLRVSAEIWKQGDQYSCMVGHEALPMNFTQKTIDRLSGKPTNVSVS
VIMSEGD A. mIgA WCH2 T4CH3 (SEQ ID NO: 255)
Nucleotide sequence:
Gttgttgatcacatctgttctcctcctactactcctcctccaccttcctgccagcccagcctgtcactgcagcggccagctcttgagga
cctgctcctgggttcagatgccagcatcacatgtactctgaatggcctgagagatcctgagggagctgtcttcacctgggagccctc
cactgggaaggatgcagtgcagaagaaagctgtgcagaattcctgcggctgctacagtgtgtccagcgtcctgcctggctgtgctg
agcgctggaacagtggcgcatcattcaagtgcacagttaccatcctgagtctgacaccttaactggcacaattgccaaagtcaca
gtgaacaccttcccacccaggtccacctgctaccgccgccgtcggaggagctggccctgaatgagctcgtgtccctgacatgcc
tggtgcgagcttcaaccctaaagaagtgctggtgcgatggctgcatggaaatgaggagctgtcccagaaagctacctagtgtttg
agccccataaaggagccaggcgaggagccaccacctacctggtgacaagcgtgttgcgtgtatcagctgaaatctggaaacagg
gtgaccagtactcctgcatggtgggccacgaggccttgcccatgaacttcacccagaagaccatcgaccgtctgtcgggtaaacc
caccaatgtcagcgtgtctgtgatcatgtcagagggagattgataatctagat Amino acid sequence (SEQ ID NO: 256):
DHICSPPTTPPPPSCQPSESLQPPALEDLLLGSDASITCTLNGLRDPEGAVFTWEPST
GKDAVQKKAVQNSCGCYSVSSVLPGCAERWNSGASFKCTVTHPESDTLTGTIAKV
TVNTFPPQVHLLPPPSEELALNELVSLTCLVRAFNPKEVLVRWLHGNEELSPESYL
VFEPLKEPGEGATTYLVTSVLRVSAEIWKQGDQYSCMVGHEALPMNFTQTIDRL
SGKPTNVSVSVIMSEGD 20. K322S CH2 region (SEQ ID NO: 257)
Nucleotide sequence:
cctgaactcctggggggaccgtcagtcttcctcttccccccaaaacccaaggacaccctcatgatctcccggacccctgaggtcac
atgcgtggtggtggacgtgagccacgcagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgctcggtcaccaacaaagcccctcccagcccccatcgagaaaacaatctccaaagccaaa Amino acid sequence (SEQ ID NO: 258):
PELLGGPSVFLFPPKPKDTLMISRTPEVTCVVVDVSHEDPEVKFNWYVDGVEVHN
AKTKPREEQYNSTYRVVSVLTVLHQDWLNGKEYKCSVSNKALPAPIEKTISKAK 21. K322S CH2 WCH3 (SEQ ID NO: 259)
Nucleotide sequence:
cctgaactcctgggggaccgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgctcggtctccaacaaagcccctcccagccccatcgagaaaacaatctccaaagccaaagggcagccc
cgagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccacgcctcccgtgctgg
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggtaaatgatctaga Amino acid sequence (SEQ ID NO: 260):
PELLGGPSVFLFPPKPKDTLMISRTPEVTCVVVDVSHEDPEVKFNWYVDGVEVHN
AKTKPREEQYNSTYRVVSVLTVLHQDWLNGKEYKCSVSNKALPAPIEKTISKAKG
QPREPQVYTLPPSRDELTKNQVSLTCLVKGFYPSDIAVEWESNGQPENNYKTTPPV
LDSDGSFFLYSKLTVDKSRWQQGNVFSCSVMHEALHNHYTQKSLSPGK 1. K322L CH2 WCH3 (SEQ ID NO: 261)
Nucleotide sequence:
tgatcaggagcccaaatcttctgacaaaactcacacatccccaccgtcctcagcacctgaactcctgggggaccgtcagtcttcct
cttccccccaaaacccaaggacaccctcatgatctcccggacccctgaggtcacatgcgtggtggtggacgtgagccacgaaga
ccctgaggtcaagttcaactggtacgtggacggcgtggaggtgcataatgccaagacaaagccgcgggaggagcagtacaaca
gcacgtaccgtgtggtcagcgtcctcaccgtcctgcaccaggactggctgaatggcaaggagtacaagtgcctggtctccaacaa
agcccctcccagccccatcgagaaaacaatctccaaagccaaagggcagccccgagaaccacaggtgtacaccctgcccccat
cccgggatgagctgaccaagaaccaggtcagcctgacctgcctggtcaaaggcttctatcccagcgacatcgccgtggagtggg
agagcaatgggcagccggagaacaactacaagaccacgcctcccgtgctggactccgacggctccttcttcctctacagcaagct
caccgtggacaagagcaggtggcagcaggggaacgtcttctcatgctccgtgatgcatgaggctctgcacaaccactacacgca
gaagagcctctccctgtctccgggtaaatgatctaga Amino acid sequence (SEQ ID NO: 262):
DQEPKSSDKTHTSPPSSAPELLGGPSVFLFPPKPKDTLMISRTPEVTCVVVDVSHED
PEVKFNWYVDGVEVHNAKTKPREEQYNSTYRVVSVLTVLHQDWLNGKEYKCLV
SNKALPAPIEKTISKAKGQPREPQVYTLPPSRDELTKNQVSLTCLVKGFYPSDIAVE
WESNGQPENNYKTTPPVLDSDGSFFLYSKLTVDKSRWQQGNVFSCSVMHEALHN
HYTQKSLSLSPGK 22. 2H7 scFv VHL11S hIgG1 (SSS-S)H K322SCH2 WCH3 (SEQ ID NO: 263)
Nucleotide sequence:
aagcttgccgccatggattttcaagtgcagattttcagcttcctgctaatcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctggaccaagctggaggctgaaagatggcggtggctcgggcggtggtggatctggaggaggtg
ggagctctcaggcttatctacagcagactggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcccacaatgaagttctaggcaaggccaactgactgtagacaaatcctccagcacaatcgccgtacatgcagctcag
cagcctgccatctgaagactctgcggtctatttctgtgcaagagtggtgtactatagtaactcttactggtacttcgatgtctgggcac
agggaccacggtcaccgtctcttctgatcaggagcccaaatcttctgacaaaactcacacatccccaccgtcctcagcacctgaact
cctgggggaccgtcagtcttcccttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagac
cgcgggaggagcagtacaacagcacgtaccgtgtggtcagcgtcctcaccgtcctgcaccaggactggctgaatggcaaggag
tacaagtgctcggtctccaacaaagcccctcccagccccatcgagaaaacaatctccaaagccaaagggcagccccgagaacca
caggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacgg
ctccttcttcctctacagcaagctcaccgtggacaagagcaggtggcagcaggggaacgtcttctcatgctccgtgatgcatgagg
ctctgcacaaccactacacgcagaagagcctctccctgtctccgggtaaatgatctaga Amino acid sequence (SEQ ID NO: 264):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGPSFLFPPKPKDTLMISRTPEVTCVVVDVSHEDPEVKFNWYV
DGVEVHNAKTKPREEQYNSTYRVVSVLTVLHQDWLNGKEYKCSVSNKALPAPIE
KTISKAKGQPREPQVYTLPPSRDELTKNQVSLTCLVKGFYPSDIAVEWESNGQPEN
NYKTTPPVLDSDGSFFNYSKLTVDKSRWQQGNVFSCSVMHEALHNHYTQKSLSLS
PGK 23. 2H7 scFv VHL11S hIgG1 (SSS-S)H K322LCH2 WCH3 (SEQ ID NO: 265)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt -continued taacccacccacgttcggtgctgggaccaagctggagctgaaagatggcggtggctcgggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcctcagcacctgaact
cctgggggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcggggaggagcagtacaacagcacgtaccgtgtggtcagcgtcctcaccgtcctgcaccaggactggctgaatggcaaggag
tacaagtgcctggtctccaacaaagcctcccagcccccatcgagaaaacaatctccaaagccaaagggcagccccgagaacca
caggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacgg
ctccttcttcctctacagcaagctcaccgtggacaagagcaggtggcagcaggggaacgtcttctcatgctccgtgatgcatgagg
ctctgcacaaccactacacgcagaagagcctctccctgtctccggtaaatgatctaga Amino acid sequence (SEQ ID NO: 266):
MDFQVQIFSFLLISASVIIARGQIYLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVTFCARVVYYSNSYWYFDVWGTGTTVTVSSDQEPKSSDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCLVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 24. 2H7 scFv VHL11S hIgG1 (CSS-S)H K322SCH2 WCH3 (SEQ ID NO: 267)
Nucleotide sequence:
aagcttgccgccatggatttttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccacccacgttcggtgctgggaccaagctggagctgaaagatggcggtggctcgggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctamctgtgcaagagtggtgtactatagtaactcttactggtacttcgatgtctggggcac
agggaccacggtcaccgtctcttctgatcaggagcccaaatcttgtgacaaaactcacacatccccaccgtcctcagcacctgaact
cctgggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcggggaggagcagtacaacagcacgtaccgtgtggtcagcgtcctcaccgtcctgcaccaggactggctgaatggcaaggag
tacaagtgctcggtctccaacaaagcctcccagcccccatcgagaaaacaatctccaaagccaaagggcagccccgagaacca
caggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacgg
ctccttcttcctctacagcaagctcaccgtggacaagagcaggtggcagcaggggaacgtcttctcatgctccgtgatgcatgagg
ctctgcacaaccactacacgcagaagagcctctccctgtctccgggtaaatgatctaga Amino acid sequence (SEQ ID NO: 268):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGITVTVSSDQEPKSCDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCSVSNKALPAPIE
KTISKAKGQPREPQVYTLPPSRDELTKNQVSLTCLVKGFYPSDIAVEWESNGQPEN
NYKTTPPVLDSDGSFFLYSELTVDKSRWQQGNVFSCSVMHEALHNHYTQKSLSLS
PGK 25. P331S CH2 (SEQ ID NO: 269)
Nucleotide sequence:
cctgaactcctgggggaccgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcggggaggagcagtacaacagcacgtaccgtgtggtcagcgtcctcaccgtcctgcaccaggactggctgaatg
gcaaggagtacaagtgcaaggtctccaacaaagcctcccagcctccatcgagaaaacaatctccaaagccaaa Amino acid sequence (SEQ ID NO: 270)
PELLGGPSVFLFPPKPKDTLMISRTPEVTCVVVDVSHEDPEVKFNWYVDGVEVHN
AKTKPREEQYNSTYRVVSVLTVLHQDWLNGKBYKCKVSNKALPASIEKTISKAK 26. P331S CH2 WCH3 (SEQ ID NO: 271)
Nucleotide sequence:
cctgaactcctgggggaccgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcggggaggagcagtacaacagcacgtaccgtgtggtcagcgtcctcaccgtcctgcaccaggactggctgaatg
gcaaggagtacaagtgcaaggtctccaacaaagcctcccagcctccatcgagaaaacaatctccaaagccaaagggcagccc
cgagaaccacaggtgtacaccctgcccccatcccgggatgagctgaccaagaaccaggtcagcctgacttgcctggtcaaagg
cttctatcccagcgacatcgccgtggagtgggagagcaatgggcagccggagaacaactacaagaccacgcctcccgtgctgg -continued
```
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggtaaatgatctaga
```

Amino acid sequence (SEQ ID NO: 272)
```
PELLGGPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPASIEKTISKAKG
QPREPQVYTLPPSRDELTKNQVSLTCLVKGFYPSDIAVEWESNGQPENNYKTTPPV
LDSDGSFFLYSKLTVDKSRWQQGNVFSCSVHEALHNHYTQKSLSLSPGK
```

27. 2H7 scFv VH L11S (SSS-S)H P331S CH2 WCH3 (SEQ ID NO: 273)
Nucleotide sequence:
```
aagcttgccgccatggattttcaagtgcagattttcagcttcctgctaatcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctgaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacaggggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttcctgatcaggagcccaaatcttctgacaaaactcacacatccccaccgtcctcagcacctgaact
cctggggggaccgtcagtcttcctcttccccccaaaaccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcctccatcgagaaaacaatctccaaagccaaagggcagccccgagaacca
caggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacgg
ctccttcttcctctacagcaagctcaccgtggacaagagcaggtggcagcaggggaacgtcttctcatgctccgtgatgcatgagg
ctctgcacaaccactacacgcagaagagcctctccctgtctccgggtaaatgatctaga
```

Amino acid sequence (SEQ ID NO: 274)
```
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGPSVFLFPKPKDTLMISRTPEVTCVVVDVSHEDPEVKFNWYV
DGVEVENAKTKPREEQYNSTYRVVSVLTVLHQDWLNGKEYKCKVSNKALPASIE
KTISKAKGQPREPQVYTNPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK
```

28. 2H7 scFv VH L11S (CSS-S)H P331S CH2 WCH3 (SEQ ID NO: 275)
Nucleotide sequence:
```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggcggtggtggatctgaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacaggggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatccccaccgtcctcagcacctgaact
cctggggggaccgtcagtcttcctcttccccccaaaaccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcctccatcgagaaaacaatctccaaagccaaagggcagccccgagaacca
caggtgtacaccctgcccccatcccgggatgagctgaccaagaaccaggtcagcctgacctgcctggtcaaaggcttctatccca
gcgacatcgccgtggagtgggagagcaatgggcagccggagaacaactacaagaccacgcctcccgtgctggactccgacgg
ctccttcttcctctacagcaagctcaccgtggacaagagcaggtggcagcaggggaacgtcttctcatgctccgtgatgcatgagg
ctctgcacaaccactacacgcagaagagcctctccctgtctccgggtaaatgatctaga
```

Amino acid sequence (SEQ ID NO: 276)
```
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPASIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK
```

29. T256N CH2 region (SEQ ID NO: 277)
Nucleotide sequence:
```
Cctgaactcctggggggaccgtcagtcttcctcttccccccaaaacccaaggacaccctcatgatctcccggaaccctgaggtca
catgcgtggtggtggacgtgagccacgaagaccctgaggtcaagttcaactggtacgtggacggcgtggaggtgcataatgcca
```

-continued agacaaagccgcgggaggagcagtacaacagcacgtaccgtgtggtcagcgtcctcaccgtcctgcaccaggactggctgaat
ggcaaggagtacaagtgcaaggtctccaacaaagccctcccagcccccatcgagaaaacaatctccaaagccaaa Amino acid sequence (SEQ ID NO: 278)
PELLGGPSVFLFPPKPKDTEMISRNPEVTCVVVVDVSHEDPEVKFNWYVDGVEVHN
AKTKPREEQYNSTYRVVSVLTVLHQDWLNGKEYKCKVSNKALPAPIEKTISKAK 30. T256N CH2 WCH3 (SEQ ID NO: 279)
Nucleotide sequence:
cctgaactcctgggggggaccgtcagtcctcctcttccccccaaaacccaaggacaccctcatgatctcccggaaccctgaggtcac
atgcgtggtggtggacgtgagccacgaagaccctgaggtcaagttcaactggtacgtggacggcgtggaggtgcataatgccaa
gacaaagccgcgggaggagcagacaacagcacgtaccgtgtggtcagcgtcctcaccgtcctacaccaggactggctgaatg
gcaaggagtacaagtgcaaggtctccaacaaagccctcccagcccccatcgagaaaacaatctccaaagccaaagggcagccc
cgagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccacgcctcccgtgctgg
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggtaaatgatctaga Amino acid sequence (SEQ ID NO: 280)
PELLGGPSVFLFPPKPKDTLMISRNPEVTCVVVDVSHEDPEVKFNWYVDGVEVHN
AKTKPREEQYNSTYRVVSVLTVLHQDWLNGKEYKCKVSNKALPAPIEKTISKKAKG
QPREPQVYTLPPSRDELTKNQVSLTCLVKGFYPSDIAVEWESNGQPENNYKTTPPV
LDSDGSFFLYSKLTVDKSRWQQGNVFSCSVMHEALHNHYTQKSLSLSPGK 31. 2H7 scFv VH L11S (SSS-S)H T256N CH2 WCH3 (SEQ ID NO: 281)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggccggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgattaggagcccaaatcttctgacaaaactcacacatccccaccgtcctcagcacctgaact
cctgggggaccgtcagtcttcctcttccccccaaaacccaaggacaccctcatgatctcccggaaccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 282)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVVEAEDAATYYCQQWS
FNPPTHGAGTKLELKDGGGSGGGGSGGGGSSQAYLQQSGAESVRPGASVKMSCK
ASGYTFTSYNMHWVKQTPRQLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGPSVFLFPPKPKDTLMISRNPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGFFLYSKLTVDKSRWQQGNVFSCSVMHEALHNHYTQKSLSL
SPGK 32. 2H7 scFv VH L11S (CSS-S)H T256N CH2 WCH3 (SEQ ID NO: 283)
Nucleotide sequence:
aagcttgccgccatggattttcaagtgcagattttcagcttcctgctaatcagtgcttcagtcataattgccagaggacaaatgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccacttattactgccagcagtggagttt
taacccaccccacgttcggtgctgggaccaagctggagctgaaagatggcggtggctcggccggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatccccaccgtcctcagcacctgaact
cctgggggaccgtcagtcttcctcttccccccaaaacccaaggacaccctcatgatctcccggaaccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 284)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDK
THTSPPSSAPELLGGPSVFLFPPKPKDTLMISRNPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKETVDKSRWQQGNVFSCSVMHEALHNHYTQKSLSL
SPGK 33. RTPE/QNAK (255-258) CH2 (SEQ ID NO: 285)
Nucleotide sequence:
cctgaactcctgggggaccgtcagtcttcctcttccccccaaaacccaaggacaccctcatgatctcccagaacgctaaggtcac
atgcgtggtggggacgtgagccacgaagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgcaaggtctccaacaaagcctcccagcccccatcgagaaaacaatctccaaagccaaa Amino acid sequence (SEQ ID NO: 286)
PELLGGPSVFLFPPKPKDTLMISQNAKVTCVVVDVSHEDPEXTKFNWYVDGVEVHN
AKTKPREEQYNSTYRVVSVLTVLHQDWLNGKEYKCKVSNKALPAPIEKTISKAK 34. RTPE/QNAK (255-258)CH2 WCH3 (SEQ ID NO: 287)
Nucleotide sequence:
cctgaactcctgggggaccgtcagtcttcctcttccccccaaaacccaaggacaccctcatgatctcccagaacgctaaggtcac
atgcgtggtggtggacgtgagccacgaagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgcaaggtctccaacaaagcctcccagcccccatcgagaaaacaatctccaaagccaaagggcagcccc
gagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccacgcctcccgtgctgg
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggtaaatgatctaga Amino acid sequence (SEQ ID NO: 288)
PELLGGPSVFLFPPKPKDTLMISQNAKVTCVVVDVSHEDPEVKFNWYVDGVEVHN
AKTKPREEQYNSTYRVVSVLTVLHQDWLNGKEYKGKVSNKALPALPIEKTISKAKG
QPREPQVYTLPPSRDELTKNQVSLTCLVKGFYPSDIAVEWESNGQPENNYKTTPPV
LDSDGSFFLYSKLTVDKSRWQQGNVFSCSVMHEALHNHYTQKSLSLSPGK 35. 2H7 scFv VH L11S (SSS-S)H RTPE/QNAK (255-258)CH2 WCH3 (SEQ ID NO: 289)
Nucleotide sequence:
aagctgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt
taacccacccacgttcggtgctgggacaaagctggagctggagctgaaagatggcggtggctcggcggtggtggatctggaggagtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagttgtgtactatagtaactcttactggtacttcgatgtctggggcac
agggaccacggtcaccgtctcttctgatcaggagcccaaatcttctgacaaaactcacacatcccccaccgtcctcagcacctgaact
cctgggggaccgtcagtcttcctcttccccccaaaacccaaggacaccctcatgatctcccagaacgctaaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagcctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagcttaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 290)
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTKGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGPSVFLFPPKPKDTLMISQNAKTCVVVSVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 36. 2H7 scFv VH L11S (CSS-S)H RTPE/QNAK (255-258)CH2 WCH3 (SEQ ID NO: 291)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgccccatccaacctggcttctggagtccctgctcgcttcagtg
gcagtgggtctgggacctcttactctctcacaatcagcagagtggaggctgaagatgctgccacttattactgccagcagtggagttt -continued taacccacccacgttcggtgctgggaccaagctggagctgaaagatggcggtggctcggcggtggtggatctggaggaggtg
ggagctctcaggcttatctacagcagtctggggctgagtcggtgaggcctggggcctcagtgaagatgtcctgcaaggcttctggc
tacacattaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcgcaagagtggtgtactatagtaactcttactggtacttcgatgtctggggcac
agggaccacggtcaccgtctcttctgatcaggagcccaaatcttgtgacaaaagctcacacatccccaccgtcctcagcacctgaact
cctgggggaccgtcagtcttcctcttccccccaaaacccaaggacaccctcatgatctcccagaacgctaaggtcacatgcgtgg
tggtggacgtgagccacgaagaccctgaggtcaagttcaactggtacgtggacggcgtggaggtgcaaatgccaagacaaagc
cgcggggaggagcagtacaacagcacgtaccgtgtggtcagcgtcctcaccgtcctgcaccaggactggctgaatggcaaggag
tacaagtgcaaggtctccaacaaagcctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagatgagcctctccctgtctccgggtaaatgatctaga Amino acid sequence (SEQ ID NO: 292)
MDFQVQIFSFLLISASVIIARGQIVLSQSPAILSASPGEKVTMTCRASSSVSYMHWY
QQKPGSSPKWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDK
THTSPPSSAPELLGGPSVFLFPPKPKDTLMISQNAKVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 36. K290Q CH2 region (SEQ ID NO: 293)
Nucleotide sequence:
cctgaactcctgggggaccgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacacagccgcggggaggagcagtacaacagcacgtaccgtgtggtcagcgtcctcaccgtcctgcaccaggactggctgaatg
gcaaggagtacaagtgcaaggtctccaacaaagcctcccagcccccatcgagaaaacaatctccaaagccaaa Amino acid sequence (SEQ ID NO: 294):
PELLGGPSVFLFPPKPKDTLMISRTPEVTCVVVDVSHEDPEVKFNWYVDGVEVHN
AKTQPREEQYNSTYRVVSVLTVLHQDWLNGKEYKCKVSNKALPAPIEKTISKAK 37. K290Q CH2 WCH3 (SEQ ID NO: 295)
Nucleotide sequence:
Cctgaactcctgggggaccgtcagtcttcctcttccccccaaaacccaaggacaccctcatgatctcccggaccccctgaggtca
catgcgtggtggtggacgtgagccacgaagaccctgaggtcaagttcaactggtacgtggacggcgtggaggtgcataatgcca
agacacagccgcggggaggagcagtacaacagcacgtaccgtgtggtcagcgtcctcaccgtcctgcaccaggactggctgaat
ggcaaggagtacaagtgcaaggtctccaacaaagcctcccagcccccatcgagaaaacaatctccaaagccaaagggcagcc
ccgagaaccacaggtgtacaccccgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaatgatctaga Amino acid sequence (SEQ ID NO: 296):
PELLGGPSVFLFPPKPKDTLMISRTPEVTCVVVDVSGEDPEVKFNWYVDGVEVHN
AKTQPREEQYNSTYRVVSVLTVLHQDWLNGKEYKCKVSNKALPAPIEKTISKAKG
QPREPQVYTLPPSRELTKNQVSLTCLVKGFYPSDIAVEWESNGQPENNYKTTPPV
LDSDGSFFLYSKLTVDKSRWQQGNVFSCSVMHEALHNHYTQKSLSLSPGK 38. 2H7 scFv VH L11S (SSS-S)H K290Q CH2 WCH3 (SEQ ID NO: 297)
Nucleotide sequence:
aagcttgcccgccatggattttcaagtgcagattttcagcttcctgctaatcagtgcttcagtcataattgccagaggaaaaattgttctct
cccagtctccagcaatcctgtctgcatctccaggggagaagtcacaatgacttgcagggccagctcaagtgtaagttacatgcact
ggtaccagcagaagccaggatcctcccccaaaccctggatttatgcccatccaacctggctctctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagctgaaagatggcggtggctcggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatccccaccgtcctcagcacctgaact
cctgggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacacagc
cgcggggaggagcagtacaacagcacgtaccgtgtggtcagcgtcctcaccgtcctgcaccaggactggctgaatggcaaggag
tacaagtgcaaggtctccaacaaagcctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 298):
MDFQVQIFSFLLISASVIIARGQIVLSQSPAILSASPGEKVTMTCRASSSVSYMHWY
QQKPGSSPKWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK -continued

```
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGPSVFLFPPKPKDTLMISRTPEVTCVVVDVSHEDPEVKFNWYV
DGVEVHNAKTQPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK
```

39. 2H7 scfv VH L11S (CSS-S)H K290Q CH2 WCH3 (SEQ ID NO: 299)
Nucleotide sequence:

```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctaacaatcagcagagtggaggctgaagatgctgaagatgctgccactcattactgccagcagtggagttt
taacccaccacgttcggtgctgggaccaagctggagctgaaagatggcggtggctcggccggtggtggatctgaggaggtg
ggagctctcaggcttatcaacagcagtctgggctgagtcggtgaggcctggggcctcagtgaagatgtcctgcaaggcttctggc
tacacatttaccagttacaatatgcactgggtaaagcagacacctagacagggcctggaatggattggaactatttatccaggaaat
ggtgatacttcctacaatcagaagtcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatccccaccgtcctcagcacctgaact
cctggggggaccgtcagtcttcctcttccccccaaaacccaaggacaccctcatgatctcccggaccctgaggtcacatgcgtgg
tggtggacgtgagccacgaagaccctgaggtcaagttcaactggtacgtggacggcgtggaggtgcataatgccaagac
cgcggggaggagcagtacaacagcacgtaccgtgtggtcagcgtcctcaccgtcctgcaccaggactggctgaatggcaaggag
tacaagtgcaaggtctccaacaaagccctcccagcccccatcgagaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga
```

Amino acid sequence (SEQ ID NO: 300):

```
MDFQVQIFSFLLISASVIIARGQIVLSQSPAILSASPGEKVTMTCRASSSVSYMIHWY
QQKPGSSPKPW1YAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMIIWVKQTPRQGLEWIGAIYPGNGDTSYNQKFKGKATLTVDKSSS
TAYMQLSSLTSEDSAVYFGARVVYYSNSYWYFDVWGTGTTVTVSSDQEPKSCDK
THTSPPSSAPELLGGPSVFLFPPKPKDTLMISRTPEVTCVVVDVSHEDPEVKFNWYV
DGVEVHNAKTQPREEQYNSTYRVVSVLTVLHQDWLNGKEYKGKVSNKALPAJ4E
KTISKAKGQPREPQVYTLPPSRDELTKNQVSLTCLVKGFYPSDIIAVEWESNGQPEN
NYKTTPPVLDSDGSFFLYSKLTVDKSRWQQGNVFSCSVMHEALHNHYTQKSLSLS
PGK
```

40. A339PCH2 (SEQ ID NO: 301)
Nucleotide sequence:

```
cctgaactcctggggggaccgtcagtcttcctcttccccccaaaacccaaggacaccctcatgatctcccggaccctgaggtcac
atgcgtggtggtggacgtgagccacgaagaccctgaggtcaagttcaactggtacgtggacggcgtggaggtgcataatgccaa
gacaaagccgcggggaggagcagtacaacagcacgtaccgtgtggtcagcgtcctcaccgtcctgcaccaggactggctgaatg
gcaaggagtacaagtgcaaggtctccaacaaagccctcccagcccccatcgagaaacaatctccaaacccaaa
```

Amino acid sequence (SEQ ID NO: 302):

```
PELLGGPSVFLFPPKPKDTLMISRTPEVTCVVVDVSHEDPEVKFNWYVDGVEVHN
AKTKPREEQYNSTYRVVSVLIVLHQDWLNGKEYKCKVSNKALPAPIEKTISKPK
```

41. A339P CH2 WCH3 (SEQ ID NO: 303)
Nucleotide sequence:

```
cctgaactcctggggggaccgtcagtcttcctcttccccccaaaacccaaggacaccctcatgatctcccggaccctgaggtcac
atgcgtggtggtggacgtgagccacgaagaccctgaggtcaagttcaactggtacgtggacggcgtggaggtgcataatgccaa
gacaaagccgcggggaggagcagtacaacagcacgtaccgtgtggtcagcgtcctcaccgtcctgcaccaggactggctgaatg
gcaaggagtacaagtgcaaggtctccaacaaagccctcccagcccccatcgagaaacaatctccaaacccaaagggcagccc
cgagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccccgcctcccgtgctgg
actccgacggctccttcttcctctacagcaagctcaccgtggacaagagcaggtggcagcaggggcccgtcttctcatgctccgtg
atgcatgaggctctgcacaaccactacacgcagaagagcctctccctgtctccgggtaaatgatctaga
```

Amino acid sequence (SEQ ID NO: 304):

```
PELLGGPSVFLFPPKPKDTLMISRTPEVTCVVVDVSHEDPEVKFNWYVDGVEVHN
AKTKLPREEQYNSTYRVVSVLTVLHQDWLNGKEYKCKVSNKALPAPIEKTISKPKG
QPREPQVYTLPPSRDELTKNQVSLTCLVKGFYPSDIAVEWESNGQPENNYKTTPPV
LDSDGSFFLYSKLTVDKSRWQQGNVFSCSVMHTEALHNHYTQKSLSLSPGK
```

42. 2H7 scFv VHL11S (SSS-S)H A339P CH2 WCH3 (SEQ ID NO: 305)
Nucleotide sequence:

```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctggagtccctgctcgcttcagtg
gcagtgggtctgggacctcttactctctcacaatcagcagagtggaggctgaagatgctgccactcattactgccagcagtggagttt
taacccaccacgttcggtgctgggaccaagctggagctgaaagatggcggtggctcggccggtggtggatctgaggaggtg
ggagctctcaggcttatctacagcagtctgggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
```

-continued agggaccacggtcaccgtctcttctgatcaggagcccaaatcttctgacaaaactcacacatccccaccgtcctcagcacctgaact
cctgggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaacccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 306):
MSFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLFLLKDGGGSGGGGSGGGGSSQAYLQQSGAEVRPGASVKMSCK
ASGYTFTSYNMHWVKQTPRQGLEWIGAIYPGNGDTSYNQKFKGKATLTVDKSSS
TAYQMLSSLTSEDSAVYFCARVVYYSNSYWYFDVWGTGTTVTVSSDQEPKSSDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKPKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 43. 2H7 scFv VHL11S (CSS-S)H A339P CH2 WCH3 (SEQ ID NO: 307)
Nucleotide sequence:
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggctctgggagtccctgccgcttcagtg
gcagtgggtctgggacctcttactctctcacaatcagcagagtggaggctgaagatgctgccactcattactgccagcagtggagttt
taacccaccccacgttcggtgctgggaccaagctggagctgaaagatggcggtggctcgggcggtggtggatctggaggagtg
ggagctctcaggctctatctacagcagtctggggctgagtcggtgaggcctggggcctcagtgacgatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcccagctctacatgcagctcag
cagcctgacatctgaagactctgaggtctatttctgtgcaagagtggtgtactatagtaactcttactggcacttcgatgtctggggcac
agggaccacggtcaccgtctcttctgatcaggagcccaaatcttctgtgacaaaactcacacatccccaccgtcctcagcacctgaact
cctgggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaacccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga Amino acid sequence (SEQ ID NO: 308):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAEVSRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSVDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKPKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 44. G28-1VH (SEQ ID NO: 309)
Nucleotide sequence:
gcggtccagctgcagcagtctggacctgagctggaaaagcctggcgcttcagtgaagatttcctgcaaggcttctggttactcattc
actggctacaatatgaactgggtgaagcagaataatggaaagagccttgagtggattggaaatattgatccttattatggtggtacta
cctacaaccggaagttcaagggcaaggccacattgactgtagacaaatcctccagcacagcctacatgcagctcaagagtctgac
atctgaggactctgcagtctattactgtgcaagatcggtcggcccctatggactactggggtcaaggaacctcagtcaccgtctcttct
gatcag Amino acid sequence (SEQ ID NO: 310):
AVQLQQSGPELEKPGASVKISCKASGYSFTGYNMNWVKQNNGKSLEWIGNIDPY
YGGTTYNRKFKGKATLIVDKSSSTAYMQLKSLTSEDSAVYYCARSVGPMDYWG
QGTSVTVSSDQ 45. G28-1VL (SEQ ID NO: 311)
Nucleotide sequence:
aagcttgccgccatggtatccacagctcagttccttgggttgctgctgctgtggcttacaggtggcagatgtgacatccagatgactc
agtctccagcctccctatctgcatctgcgggagagactgtcaccatcacatgtcgaacaagtgaaaatgtttacagttatttggcttggt
atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtca Amino acid sequence (SEQ ID NO: 312):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPMDSGSYFCQHHS
DNPWTFGGGTELEIKGGGGSGGGGSGGGGSS 46. G28-1 scFv (SEQ ID NO: 313)
Nucleotide sequence:
aagcttgccgccatggtatccacagctcagttccttgggttgctgctgctgtggcttacaggtggcagatatgacatccagatgactc
agtctccagcctcccctatctgcatctgtgggagagactgtcaccatcacatgtcgaacaagtgaaaatgatacagttatttggcttggt
atcagcagaaacagggaaaatcacatcagctcctggtctcttttgcaaaaacccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagctggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaagagtct
gacatctgaggactctgcagtctattactgtgcaagatcggtcggccctatggactactgggtcaaggaacctcagtcaccgtctc
ttctgatcag Amino acid sequence (SEQ ID NO: 314):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPELEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQ 47. G28-1 VHL11S (SEQ ID NO: 315)
Nucleotide sequence:
gcggtccagctgcagcagtctggacctgagtcggaaaagcctggcgcttcagtgaagatttcctgcaaggctttctggttactcattc
actggctacaatatgaactgggtgaagcagaataatggaaagagccttgagtggattggaaatattgatccttattatggtggtacta
cctacaaccggaagttcaagggcaaggccacattgactgtagacaaatcctccagcacagcctacatgcagctcaagagtctgac
atctgaggactctgcagtctattactgtgcaagatcggtcggccctatggactactggggtcaaggaacctcagtcaccgtctcttct
gatcag Amino acid sequence (SEQ ID NO: 316):
AVQLQQSGPESEKPGASVKISCKASGYNMNWVKQNNGKSLEWIGNIDPYY
GGTTYNRKFKGKATLTVDKSSSTAYMQLKSLTSEDSAVYYCARSVGPMDYWGQ
GTSVTVSSDQ 48. G28-1 VHL11S scFv (SEQ ID NO: 317)
Nucleotide sequence:
aagcttgccgccatggtatccacagctcagttccttgggttgctgctgctgtggcttacaggtggcagatgtgacatccagatgactc
agtctccagcctcccctatctgcatctgtgggagagactgtcaccatcacatgtcgaacaagtgaaaatgtttacagttatttggcttggt
atcagcagaaacagggaaaatctcctcagctcctggtctcttttgcaaaaacccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaagagtct
gacatctgaggactctgcagtctattactgtgcaagatcggcccctatggactggggtcaaggaacctcagtcaccgtctc
ttctgatcag Amino acid sequence (SEQ ID NO: 318):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQ 49. G28-1 scFv (SSS-S)H WCH2 WCH3 (SEQ ID NO: 319)
Nucleotide sequence:
aagcttgccgccatggtatccacagctcagttccttgggttgctgctgctgtggcttacaggtggcagatgtgacatccagatgactc
agtctccagcctcccctatctgcatctgtgggagagactgtcaccatcacatgtcgaacaagtgaaaatgtttacagttatttggcttggt
atcagcagaaacagggaaaatctcctcagctcctggtctcttttgcaaaaacccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagctggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaagagtct
gacatctgaggactctgcagtctattactgtgcaagatcggtcggccctatggactactgggtcaaggaacctcagtcaccgtctc
ttctgatcatgatcaggagcccaaatcttctgacaaaactcacacatccccaccgtcctcagcacctgaactcctggggggaccgt
agtcttctcttcccccaaaaccaaggacaccctcatgatctcccggacccctgaggtcacatgcgtggtggtggacgtgagcc
acgaagaccctgaggtcaagttcaactggtacgtggacggcgtggaggtgcataatgCcaagacaaagccgcgggaggagca
gtacaacagcacgtaccgtgtggtcagcgtcctcaccgtcctgcaccaggactggctgaatggcaaggagtacaagtgcaaggtc
tccaacaaagccctcccagcccccatcgagaaaacaatctccaaagccaaagggcagccccgagaaccacaggtgtacaccct
gcccccatcccgggatgagctgaccaagaaccaggtcagcctgacctgcctggtcaaaggcttctatcccagcgacatcgccgtg
gagtgggagagcaatgggcagccggagaacaactacaagaccacgcctcccgtgctggactccgacggctccttcttcctctac
agcaagctcaccgtggacaagagcaggtggcagcaggggaacgtcttctcatgctccgtgatgcatgaggctctgcacaaccact
acacgcagaagagcctctccctgtctccgggtaaatgatctaga -continued Amino acid sequence (SEQ ID NO: 320):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPELEKLPGASVKISCKA
SGYSFTGYNMNWVKQNGKSLEWIGNIDPYYGGTTYNRKFKGKATLTVDKSSST
AYMQLKSLTSEDSAVYYCARSVGPMDYWGQGTSVTVSSDHDQEPKSSDKTHTSP
PSSAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKT
TPPVLDSGSFFLYSKLTVDKSRWQQGNVFSCSVMHEALHNHYTQKSLSLSPGK 50. G28-1 scFv IgAW H IgG1WCH2 WCH3 (SEQ ID NO: 321)
Nucleotide sequence:
aagcttgccgccatggtatccacagctcagttccttgggttgctgctgctgtggcttacaggtggcagatgtgacatccagatgactc
agtctccagcctccctatctgcatctgtgggagagactgtcaccatcacatgtcgaacaagtgaaaatgtttacagttatttggcttggt
atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagctggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaaggcaaggccacattgactgtagacaaatcctccagcacagcctacatgcagctcaagagtct
gacatctgaggactctgcagtctattactgtgcaagatcggtcggcccatggactactggggtcaaggaacctcagtcaccgtctc
ttctgatcagcagttccctcaactccacctaccccatctccctcaactccacctacccatctcccatgcgcacctgaactcctgg
ggggaccgtcagtcttcctcttccccccaaaacccaaggacacccctcatgatctcccggacccctgaggtcacatgcgtggtggtg
gacgtgagccacgaagaccctgaggtcaagttcaactggtacgtggacggcgtggaggtgcataatgccaagacaaagccgcg
ggaggagcagtacaacagcacgtaccgtgtggtcagcgtcctcaccgtcctgcaccaggactggctgaatggcaaggagtacaa
gtgcaaggtctccaacaaagcccctcccagccccatcgagaaaacaatctccaaagccaaagggcagccccgagaaccacagg
tgtacaccctgcccccatcccgggatgagctgaccaagaaccaggtcagcctgacctgcctggtcaaaggcttctatcccagcga
catcgccgtggagtgggagagcaatgggcagccggagaacaactacaagaccacgcctcccgtgctggactccgacggctcct
tcttcctctacagcaagctcaccgtggacaagagcaggtggcagcaggggaacgtcttctcatgctccgtgatgcatgaggctctg
cacaaccactacacgcagaagagcctctccctgtctccgggtaaatgatctaga Amino acid sequence (SEQ ID NO: 322):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQKHS
DNPWTFGGGTELEIKGGGGSGGGGSGGGGSSAVQLQQSGPELEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQPVPSTPPTPSPSTPPT
PSPSCAPELLGGPSVFLFPPKPKDTLMISRTPEVTCVVVDVSHEDPEVKFNWYVDG
VEVHNAKTKPREEQYNSTYRVVSVLTVLHQDWLNGKEYKCKVSNKALPAPIEKTI
SKKGQPREPQVYTLPPSRDELTKNQVSLTCLVKGFYPSDIAVEWESNGQPENNY
KTTPPVLDSGSFFLYSKLTVDKSRWQQGNVFSCSVMHEALHNHYTQKSLSLSPG
K 51. G28-1 scFv VHL11S (SSS-S)H WCH2 WCH3 (SEQ ID NO: 323)
Nucleotide sequence:
aagcttgccgccatggtatccacagctcagttccttgggttgctgctgctgtggcttacaggtggcagatgtgacatccagatgactc
agtctccagcctccctatctgcatctgtgggagagactgtcaccatcacatgtcgaacaagtgaaaatgtttacagttatttggcttggt
atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaaggcaaggccacattgactgtagacaaatcctccagcacagcctacatgcagctcaagagtct
gacatctgaggactctgcagtctattactgtgcaagatcggtcggcccatggactactggggtcaaggaacctcagtcaccgtctc
ttctgatcaggagcccaaatcttctgacaaaactcacacatccaccgtcctcagcacctgaactctggggggaccgtcagtctt
cctcttcccccaaaacccaaggacacccctcatgatctcccggacccctgaggtcacatgcgtggtggtggacgtgagccacgaa
gaccctgaggtcaagttcaactggtacgtggacggcgtggaggtgcataatgccaagacaaagccgcgggaggagcagtacaa
cagcacgtaccgtgtggtcagcgtcctcaccgtcctgcaccaggactggctgaatggcaaggagtacaagtgcaaggtctccaac
aaagcccctcccagccccatcgagaaaacaatctccaaagccaaagggcagccccgagaaccacaggtgtacaccctgcccc
catcccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggctccttcttcctctacagcaag
ctcaccgtggacaagagcaggtggcagcaggggaacgtcttctcatgctccgtgatgcatgaggctctgcacaaccactacacgc
agaagagcctctccctgtctccgggtaaatgatctaga Amino acid sequence (SEQ ID NO: 324):
MVSTAQFLGLLLLWLTGGRCDIQMTQSPASLSASVGETITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDHDQEPKSSDKTHTSP
PSSAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKT
TPPVLDSGSFFLYSKLTVDKSRWQQGNVFSCSVMHEALHNHYTQKSLSLSPGK 52. G28-1 scFv VHL11S (CSS-S)H WCH2 WCH3 (SEQ ID NO: 325)
Nucleotide sequence:
aagcttgccgccatggtatccacagctcagttccttgggttgctgctgctgtggcttacaggtggcagatgtgacatccagatgactc
agtctccagcctccctatctgcatctgtgggagagactgtcaccatcacatgtcgaacaagtgaaaatgtttacagttatttggcttggt -continued atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatggagtgaagcagaataatggaaagagccttgagtggattggaaatattgatccttattatggtggt
actacctacaaccggaagttcaagggcaaggccacattgactgtagacaaatcctccagcacagcctacatgcagctcaaggagtct
gacatctgaggactctgcagtctattactgtgcaagatcggtcggccctatggactactggggtcaaggaacctcagtcaccgtctc
ttctgatcaggagcccaaatcttgtgacaaaactcacacatcccaccgtcctcagcacctgaactcctgggggaccgtcagtctt
cctcttccccccaaaacccaaggacaccctcatgatctcccggaccccctgaggtcacatgcgtggtggtggacgtgagccacgaa
gaccctgaggtcaagttcaactggtacgtggacggcgtggaggtgcataatgccaagacaaagccgcgggaggagcagtacaa
cagcacgtaccgtgtggtcagcgtcctcaccgtcctgcaccaggactggctgaatggcaaggagtacaagtgcaaggtctccaac
aaagcccctcccagccccatcgagaaaacaatctccaaagccaaagggcagccccgagaaccacaggtgtacaccctgccccc
atcccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggcyccyycyyccycycacagcaag
ctcaccgtggacaagagcaggtggcagcaggggaacgtcttctcatgctccgtgatgcatgaggctctgcacaaccactacacgc
agaagagcctctccctgtctccgggtaaatgatctaga Amino acid sequence (SEQ ID NO: 326):
MVSTAQFLGLLLLWLTGGRCDIQMTQSPASLSASVGETVTITCRTSENVYSYLAW
YQQKQGKPOLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQEPKSCDKTHTSPPSS
APELLGGPSVFLFPPKPKDTLMISRTPEVTCVVVDVSHEDPEVKFNWYVDGVEVH
NAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK 53. G28-1 scFv VH L11S (CSC-S)H WCH2 WCH3 (SEQ ID NO: 327)
Nucleotide sequence:
aagcttcccgccatggtatccacagctcagttccttgggttgctgctgctgtggcttacaggtggcagatgtgacatccagatgactc
agtctccagcctccctatctgcatctgtgggagagactgtcaccatcacatgtcgaacaagtgaaaatgtttacagttatttggcttggt
atcagcagaaacagggaaaatctcctcagctcctggtctcttttgcaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacaftgactgtagacaaatcctccagcacagcctacatgcagctcaaggagtct
gacatctgaggactctgcagtctattactgtgcaagatcggtcggccctatggactactggggtcaaggaacctcagtcaccgtctc
ttctgatcaggagcccaaatcttgtgacaaaactcacactctccaccgtgctcagcacctgaactcctggggtggaccgtcagtcttc
ctcttccccccaaaacccaaggacaccctcatgatctcccggaccccctgaggtcacatgcgtggtggtggacgtgagccacgaag
accctgaggtcaagttcaactggtacgtggacggcgtggaggtgcataatgccaagacaaagccgcgggaggagcagtacaac
agcacgtaccgtgtggtcagcgtcctcaccgtcctgcaccaggactggctgaatggcaaggtacaagtgcaaggtctccaaca
aagcccctcccagccccatcgagaaaacaatctccaaagccaaagggcagccccgagaaccacaggtgtacaccctgccccca
tcccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggctccttcttcctctacagcaag
ctcaccgtggacaagagcaggtggcagcaggggaacgtcttctcatgctccgtgatgcatgaggctctgcacaaccactacacgc
agaagagcctctccctgtctccgggtaaatgatctaga Amino acid sequence (SEQ ID NO: 328):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQEPKSCDKTHTSPPC
SAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTP
PVLDSDGSFFLYSKLTVDKSRWQQGNVFSCSVMHEALHNHYTQKSLSLSPGK 54. G28-1 scFv VH L11S (SSC-P)H WCH2 WCH3 (SEQ ID NO: 329)
Nucleotide sequence:
aagcttgccgccatggtatccacagctcagttccttgggttgctgctgctgtggcttacagggcagatgtgacatccagatgactc
agtctccagcctccctatctgcatctgtgggagagactgtcaccatcacatgtcgaacaagtgaaaatgtttacagttatttggcttggt
atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaaggagtct
gacatctgaggactctgcagtctattactgtgcaagatcggtcggccctatggactggggtcaaggaacctcagtcaccgtctc
ttctgatcaggagcccaaatcttgtgacaaaactcacacatcccaccgtgcccacctgaactcctgggggaccgtcagtcttc
cctcttccccccaaaacccaaggacaccctcatgatctcccggaccccctgaggtcacatgcgtggtggtggacgtgagccacgaa
gaccctgaggtcaagttcaactggtacgtggacggcgtggaggtgcataatgccaagacaaagccgcgggaggagcagtacaa
cagcacgtaccgtgtggtcagcgtcctcaccgtcctgcaccaggactggctgaatggcaaggagtacaagtgcaaggtctccaac
aaagcccctcccagccccatcgagaaaacaatctccaaagccaaagggcagccccgagaaccacaggtgtacaccctgccccc
atcccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggctccttcttcctctacagcaag
ctcaccgtggacaagagcaggtggcagcaggggaacgtcttctcatgctccgtgatgcatgaggctctgcacaaccactacacgc
agaagagcctctccctgtctccgggtaaatgatctaga Amino acid sequence: (SEQ ID NO: 330):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIEKGGGGSGGGGSGGGGSSAVQLQQSGPESEKPGASVKISCKA
SGYSFTGYNMNWVKQNNGKSLEWIGNDPYYGGTTYRKFKATLTVDKSSST.
AYMQLKSLTSEDSAVYYCARSVGPMDYWGQGTSVTVSSDQEPKSSDKTHTSPPCP
APELLGGPSVFLFPPKPKDTLMISRTPEVTCVVVDVSHEDPEVKFNWYVDGVEVH
NAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK II. 54. HCTLA4 HIGG1 (SSS-S)H P238SCH2 WCH3 (SEQ ID NO: 331)
Nucleotide sequence:
atggcttgccttggatttcagcggcacaaggctcagctgaacctggctgccaggacctggccctgcactctcctgttttttcttcttc
atccctgtcttctgcaaagcaatgcacgtggcccagcctgctgtggtactggccagcagccgaggcatcgccagctttgtgtgtga
gtatgcatctccaggcaaagccactgaggtccgggtgacagtgcttcggcaggctgacagccaggtgactgaagtctgtgcggc
aacctacatgacggggaatgagttgaccttcctagatgattccatctgcacgggcacctccagtggaaatcaatgaacctcactat
ccaaggactgagggccatggacacgggactctacatctgcaaggtggagctcatgtacccaccgccatactacctgggcatagg
caacggaaccagatttatgtaattgatccagaaccgtgcccagattctcgatcaacccaaatcttctgacaaaactcacacatcccca
ccgtcctcagcacctgaactcctggggggatcgtcagtcttcctcttcccccaaaacccaaggacaccctcatgatctcccggac
ccctcctcagcacctgaactcctggggggatcgtcagtcttcctcttcccccaaaacccaaggacaccctcatgatctcccggac
gcataatgccaagacaaagccgcggaggagcagtacaacagcacgtaccgtgtggtcagcgtcctcaccgtcctgcaccagg
actggctgaatggcaaggagtacaagtgcaaggtctccaacaaagccctcccagcccccatcgagaaaacaatctccaaagcca
aagggcagccccgagaaccacaggtgtacaccctgcccccatcccgggatgagctgaccaagaaccaggcagcctgacctgc
ctggtcaaaggcttctatcccagcgacatcgccgtggagtgggagagcaatgggcagccggagaacaactacaagaccacgcc
tcccgtgctggactccgacggctccttcttcctctacagcaagctcaccgtggacaagagcaggtggcagcaggggaacgtcttct
catgctccgtgatgcatgaggctctgcacaaccactacacgcagaagagcctctccctgtctccgggtaaatga Amino acid sequence (SEQ ID NO: 332):
MACLGFQRHKAQLNLAARTWPCTLLFFLLFIPVFCKAMHVAQPAVVLASSRGIAS
FVCEYASPGKATEVRVTVLRQADSQVTEVCAATYMTGNELTFLDDSICTGTSSGN
QVNLTIQGLRAMDTGLYICKVELMYPPPYYLGIGNGTQIYVIDPEPCPDSDQPKSSD
KTHTSPPSSAPELLGGSSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPI
EKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSL
SPGK 55. Fc2-2 VL (SEQ ID NO: 333)
Nucleotide sequence:
gttgttaagcttgccgccatggattcacaggcccaggttcttatgttactgctgctatgggtatctggtacctgtggggacattgtgatg
tcacagtctccatcctccctagctgtgtcagttggagagaaggtttctatgagctgcaagtccagcagagcctttatataatcacaat
caaaagaactacttggcctggtaccagcagataccagggcagtctcctaaactgctgattttactgggcatccactaggaatctgg
ggtcctgatcgcttcacaggcagtggatctgggacagatttcactctcaccatcagcagagtgaaggctgaagacctggcagttta
ttactgtcagcaatattatacctatcctcccacgttcggaggtggcaccaagctggaaataaaaggtggcggtggctcgggcggtg
gtgggtcggtggcggcgggagctcg Amino acid sequence (SEQ ID NO: 334):
MDSQAQVLMLLLLWVSGTCGDIVMSQSPSSLAVSVGEKVSMSCKSSQSLLYNHN
QKNYLAWYQQIPGQSPKLLIYWASTRESGVPDRFTGSGSGTDFTLTISRVKAEDLA
VYYCQQYYTYPPTFGGGTKLEIKGGGGSGGGGSGGGGSS 56. FC2-2VH (SEQ ID NO: 335)
Nucleotide sequence:
Gggagctcgcaggtgcagttgaaggagtcaggacctggcctggtggcgccctcacagagcctgtccatcacatgcaccgtctca
gggttctcattaaccgtctatggtgttaactgggttcgccagcctccaggaaagggtctggactggctgggaatgatatggggat
ggaagcacagactataattcagctcaaatccactgagcatcagtaaggacaactccaagagccaagttttcttaaaaatggac
agtctacaaactgatgacacagccaggtactactgtgccagagatcactatggtacccactatgctatggactactggggcaagga
acctcagtcaccgtctcctctgatcag Amino acid sequence (SEQ ID NO: 336):
GSSQVQLKESGPGLVAPSQSLSITCTVSGFSLTVYGVNWVRQPPGKGLDWLGMIW
GDGSTDYNSALKSRLSISKDNSKSQVFLKMDSLQTDDTARYYCARDHYGTHYAM
DYWGQGTSVTVSSDQ 57. FC2-2scFv (SEQ ID NO: 337)
Nucleotide sequence:
gttgttaagcttgccgccatggattcacaggcccaggttcttatgttactgctgctatgggtatctggtacctgtggggacattgtgatg
tcacagtctccatcctccctagctgtgtcagttggagagaaggtttctatgagctgcaagtccagtcagagcctttatataatcacaat
caaaagaactacttggcctggtaccagcagataccagggcagtctcctaaactgctgattttactgggcatccactaggaatctgg
ggtcctgatcgcttcacaggcagtggatctgggacagatttcactctcaccatcagcagagtgaaggctgaagacctggcagttta
ttactgtcagcaatattatacctatcctcccacgttcggaggtggcaccaagctggaaataaaaggtggcggtggctcgggcggtg
gtgggtcggtggcggcggagctctcaggtgcagttgaaggagtcaggacctggcctggtggcgccctcacagagcctgtcc
atcacatgcaccgtctcagggttctcattaaccgtctatggtgttaactgggttcgccagcctccaggaaagggtctggactggctgg
gaatgatatggggtgatggaagcacagactataattcagctctcaaatccagactgagcatcagtaaggacaactccaagagccaa
gttttcttaaaaatggacagtctacaaactgatgacacagccaggtactactgtgccagagatcactatggtacccactatgctatgg
actactggggtcaaggaacctcagtcaccgtctcctctgatcag Amino acid sequence (SEQ ID NO: 338):
MDSQAQVLMLLLLWVSGTCGDIVMSQSPSSLAVSVGEKVSMSCKSSQSLLYNHN
QKNYLAWYQQIPGQSPKLLIYWASTRESGVPDRFTGSGSGTDFTLTISRVKAEDLA
VYYCQQYYTYPPTFGGGTKLEIKGGGGSGGGGSGGGGSSQVQLKESGPGLVAPYSQ
SLSITCTVSGFSLTVYGVNWVRQPPGKGLDWLGMIWGDGSTDYNSALKSLSISK
DNSKSQVFLKMDSLQTDDTARYYCARDHYAMDYWGQGTSVTVSSDQ 58. FC2-2 VHL11S (SEQ ID NO: 339)
Nucleotide sequence:
gggagctctcaggtgcagttgaaggagtcaggacctggctcggtggcgccctcacagagcctgtccatcacatgcaccgtctcag
ggttctcattaaccgtctatggtgttaactgggttcgccagcctccaggaaagggtctggactggctgggaatgatatgggtgatg
gaagcacagactataattcagctctccaaatccagactgagcatcagtaaggacaactccaagagccaagttttcttaaaaatggaca
gtctacaaactgatgacacagccaggtactactgtgccagagatcactatggtacccactatgctatggactactgggtcaaggaa
cctcagtcaccgtctcctctgatcag Amino acid sequence (SEQ ID NO: 340):
(GSS)QVQLKESGPGSVAPSQSLSITCTVSGFSLTVYGVNWVRQPPGKGLDWLGMI
WGDGSTDYNSALKSRLSISKDNSKSSQVFLKMDSLQTDDTARYYCARDHYGTHYA
MDYWGQGTSVTVSSDQ 59. FC2-2 VH L11S scFv (SEQ ID NO: 341)
Nucleotide sequence:
gttgttaagcttgccgccatggattcacaggcccaggttcttatgttactgctgctatgggtatctggtacctgtggggacattgtgatg
tcacagtctccatcctcccagctgtgtcagttggagagaaggtttctatgagctgcaagtccagtcagagcctttatataatcacaat
caaaagaactacttggcctggtaccagcagataccagggcagtctcctaaactgctgatttactgggcatccactagggaatctgg
ggtccctgatcgcttcacaggcagtggatctgggacagatttcactctcaccatcagcagagtgaaggctgaagacctggcagttta
ttactgtcagcaatattatacctatcctcccacgttcggaggtggcaccaagctggaaataaaaggtggcggtggctcgggcggtg
gtgggtcggtggcggcgggagctctcaggtgcagttgaaggagtcaggacctggctcggtggcgccctcacagagcctgtcc
atcacatgcaccgtctcagggttctcattaaccgtctatggtgttaactgggttcgccagcctccaggaaagggtctggactggctgg
gaatgatatgggtgatggaagcacactataattcagctcaaatccagactgagcatcagtaaggacaactccaagagccaa
gttttcttaaaaatggacagtctacaaactgatgacacagccaggtactactgtgccagagatcactatggtacccactatgctatgg
actactgggtcaaggaacctcagtcaccgtctcctctgatcag Amino acid sequence (SEQ ID NO: 342):
MDSQAQVLMLLLLWVSGTCGDIVMSQSPSSLAVSVGEKVSMSCKSSQSLLYNHN
QKNYLAWYQQIPGQSPKLLIYWASTRESGVPDRFTGSGSGTDFTLTISRVKAEDLA
VYYCQQYYTYPPTFGGGTKLEIKGGGGSGGGGSGGGGSSQVQLKESGPGSVAPSQ
SLSITCTVSGFSLTVYGVNWVRQPPGKGLDWLGMIWGDGSTDYNSALKSRLSISK
DNSKSQVFLKMDSLQTDDTARYYCARDHYGTHYAMDYWGQGTSVTVSSDQ 60. FC2-2 (SSS-S)H WCH2 WCH3 (SEQ ID NO: 343)
Nucleotide sequence:
gttgttaagcttgccgccatggattcacaggcccaggttcttatgttactgctgctatgggtatctggtacctgtggggacattgtgatg
tcacagtctccatcctcccagctgtgtcagttggagagaaggtttctatgagctgcaagtccagtcagagcctttatataatcacaat
caaaagaactacttggcctggtaccagcagataccagggcagtctcctaaactgattttactgggcatccactagggaatctgg
ggtccctgatcgcttcacaggcagtggatctgggacagatttcactctcaccatcagcagagtgaaggctgaagacctggcagttta
ttactgtcagcaatattatacctatcctcccacgttcggaggtggcaccaagctggaaataaaaggtggcggtggctcgggcggtg
gtgggtcggtggcggcgggagctctcaggtgcagttgaaggagtcaggacctggctcggtggcgccctcacagagcctgtcc
atcacatgcaccgtctcagggttctcattaaccgtctatggtgttaactgggttcgccagcctccaggaaagggtctggactggctgg
gaatgatatgggtgatggaagcacagactataattcagctcaaatccagactgagcatcagtaaggacaactccaagagccaa
gttttcttaaaaatggacagtctacaaactgatgacacagccaggtactactgtgccagagatcactatggtacccactatgctatgg
actactgggtcaaggaacctcagtcaccgtctcctctgatcaggagcccaaatcttctgacaaaactcacacatccccaccgtcct
cagcacctgaactcctggggggaccgtcagtcttcctcttccccccaaaacccaaggacaccctcatgatctcccggacccctgag
gtcacatgcgtggtggtggacgtgagccacgaagaccctgaggtcaagttcaactggtacgtggacggcgtggaggtgcataat
gccaagacaaagccgcgggaggagcagtacaacagcacgtaccgtgtggtcagcgtcctcaccgtcctgcaccaggactggct
gaatggcaaggagtacaagtgcaaggtctccaacaaagcccttcccagcccccatcgagaaaaccatctccaaagccaaagggc
agccccgagaaccacaggtgtacaccctgcccccatcccgggatgagctgaccaagaaccaggtcagcctgacctgcctggtca
aaggcttctatccaagcgacatcgccgtggagtgggagagcaatgggcagccggagaacaactacaagaccacgcctcccgtg
ctggactccgacggctccttcttcctctacagcaagctcaccgtggacaagagcaggtggcagcaggggaacgtcttctcatgctc
cgtgatgcatgaggctctgcacaaccactacacgcagaagagcctctccctgtctccgggtaaatgatctaga Amino acid sequence (SEQ ID NO: 344):
MDSQAQVLMLLLLWVSGTCGDIVMSQSPSSLAVSVGEKVSMSCKSSQSLLYNHN
QKNYLAWYQQIPGQSPKLLIYWASTRIESGVPDRFTGSGSGTDFTLTISRVKAEDLA
VYYCQQYYTYPPTFGGGTKLEIKGGGGSGGGGSGGGGSSQVQLKESGPGLVAPSQ
SLSITCTVSGFSLTVYGVNWVRQPPGKGLDWLGMIWGDGSTDYNSALKSRLSISK
DNSKSQVFLKMDSLQTDDTARYYCARDHYGTHYAMDYWGQGTSVTVSSDQEPK
SSDKTHTSPPSSAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQ
KSLSLSPGK 61. FC2-2 VHL11S (SSS-S)H WCH2 WCH3 (SEQ ID NO: 345)
Nucleotide sequence:
gttgttaagcttgccgccatggattcacaggcccaggttcttatgttactgctgctatgggtatctggtacctgtggggacattgtgatg
tcacagtctccatcctcccagctgtgtcagttggagagaaggtttctatgagctgcaagtccagtcagagcctttatataatcacaat
caaaagaactacttggcctggtaccagcagataccagggcagtctcctaaactgctgatttactgggcatccactagggaatctgg
ggtccctgatcgcttcacaggcagtggatctgggacagatttcactctcaccatcagcagagtgaaggctgaagacctggcagttta -continued ttactgtcagcaatattatacctatcctcccacgttcggaggtggcaccaagctggaaataaaaaggtggcggtggctcgggcggtg
gtgggtcggtggcggcgggagctctcaggtgcagttgaaggagtcaggacctggctcggtggcgccctcacagagcctgtcc
atcacatgcaccgtctcagggttctcattaaccgtctatggtgttaactgggttcgccagcctccaggaaagggtctggactggctgg
gaatgatatgggtgatggaagcacagactataattcagctctcaaatccagactgagcatcagtaaggacaactccaagagccaa
gttttcttaaaaatggacagtctacaaaactgatgacacagccagttactactgtgccagagatcactatggtaccactatgctatg
actactgggtcaaggaacctcagtcaccgtctcctctgatcaggagcccaaatcttctgacaaaactcacacatccccaccgtcct
cagcacctgaactcctgggtggaccgtcagtcttcctcttcccccaaaacccaaggacaccctcatgatctcccggacccctgag
gtcacatgcgtggtggacgtgagccacgaagaccctgaggtcaagttcaactggtacgtggacggcgtggaggtgcataat
gccaagacaaagccgcgggaggagcagtacaacagcacgtaccgtgtggtcagcgtcctcaccgtcctgcaccaggactggct
gaatggcaaggagtacaagtgcaaggtctccaacaaagcccttccagccccatcgagaaaaccatctccaaagccaaagggc
agccccgagaaccacaggtgtacaccctgcccccatcccgggatgagctgaccaagaaccaggtcagcctgacctgcctggtca
aaggcttctatccaagcgacatcgccgtggagtgggagagcaatgggcagccggagaacaactacaagaccacgcctcccgtg
ctggactccgacggctccttcttcctctacagcaagctcaccgtggacaagagcaggtggcagcaggggaacgtcttctcatgctc
cgtgatgcatgaggctctgcacaaccactacacgcagaagagcctctccctgtctccgggtaaatgatctaga Amino acid sequence (SEQ ID NO: 346):
MDSQAQVLMLLLLWVSGTCGDIVMSQSPSSLAVSVGEKVSMSCKSSQSLLYNHN
QKNYLAWYQQIPGQSPKLLIYWASTRESGVPDRFTGSGSGTDFTLTISRVKAEDLA
VYYCQQYYTYPPTFGGGTKLEIIKGGGSGGGGSGGGGSSQVQLKESGPGSVAPSQ
SLSITCTVSGFSLTVYGVNWVRQPPGKGLDWLGMIWGDGSTDYNSALKSRLSISK
DNSKSQVFLKMDSLQTDDTARYYCARDHYGTHYAMDYWGQGTSVTVSSDQEPK
SSDKTHTSPPSSAPELLGGPSVFLFPPKPKDTLMISRTPEVTCVVVDVSHEDPEVKF
NWYVDGVEVHTNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQ
KSLSLSPGK 62. UCHL-1 VH (SEQ ID NO: 347)
Nucleotide sequence:
atgggcaggcttacttcttcattcctgctactgattcctgcatatgtcctctcccagattactctgaaagagtctggccctgggatctt
gcagccctcccagaccctcagtctgacttcttctctgggttttcactgaccacttatggtataggagtaggttggattcgtcagcct
ccagggaagggtctggagtggctgacacacatttggtggaatgataataagtactataacacagccctgaggagccggctcacaa
tctccaaggattcctccaacaaccaagtactcctcaagatcgccaatgtggacactgcagataccgccacatactactgtctctacg
gctacacttactggggccaagggactctggtcactgtctctgca Amino acid sequence (SEQ ID NO: 348):
MGRLTSSFLLLIVPAYVLSQITLKESGPGILQPSQTLSLTCSFSGFSLTTYGIGVGWIR
QPPGKGLEWLTHIWWNDNKYYNTALRSRLTISKDSSNNQVLLKIANVDTADTAT
YYCLYGYTYWGQGTLVTVSA 63. UCHL-1 VL (SEQ ID NO: 349)
Nucleotide sequence:
atgaagttgcctgctgttaggctgttggtgctgatgttctggattcctgcttccatcagtgatgttgtgatgacccaaactccactctccctgc
ctgtcagtcttggagatcaggcctccatctcttgcagatctagtcagagccttcttttacagtaatggaaacacctatttacattggtacct
gcagaagcccaggccagtctccaaaactcctgatctacaaacttttccaaccaaccgattttctggggtcccagacaggttcagtggcagtgg
atcagggacagatttcacactcaagatcagcagagtggaggctgaggatctgggagtttatttctgctctcaaagtacacatgttccg
tggacgttcggtggaggcaccaagctggaaatcaaa Amino acid sequence (SEQ ID NO: 350):
MKLPVRLLVLMFWIPASISDVVMTQTPLSLPVSLGDQASISCRSSQSLLYSNGNTYL
HWYLQKPGQSPKLLIYKLSNRFSGVPDRFSGSGSGTDFTLKISRVEAEDLGVYFCS
QSTHVPWTFGGGTKLEIK 64. UCHL-1 scFv (SEQ ID NO: 351)
Nucleotide sequence:
gttgttaagcttgccgccatgaagttgcctgttaggctgttggtgctgatgttctggattcctgcttccatcagtgatgttgtgatgaccc
aaaactccactctccctgcctgtcagtcttggagatcaggcctccatctcttgcagatctagtcagagccttcttttacagtaatggaaac
acctatttacattggtacctgcagaagccaggccagtctccaaaactcctgatctacaaacttttccaaccgattttctggggtcccaga
caggttcagtggcagtggatcagggacagatttcacactcaagatcagcagagtggaggctgaggatctgggagtttatttctgctc
tcaaagtacacatgttccgtggacgttcggtggaggcaccaagctggaaatcaaagatggcggtggctcggcggtggtggatct
ggaggaggtgggagctctcagattactctgaaagagtctggccctgggatcttgcagccctcccagaccctcagtctgacttgttctt
tctctgggttttcactgaccacttatggtataggagtaggttggattcgtcagcctccagggaagggtctggagtggctgacacacat
ttggtggaatgataataagtactataacacagccctgaggagccggctcacaatctccaaggattcctccaacaaccaagtactcct
caagatcgccaatgtggacactgcagataccgccacatactactgtctctacggctacacttactggggccaagggactctggtca
ctgtctctgctgatca Amino acid sequence (SEQ ID NO: 352):
MKLPVRLLVLMFWIPASISDVVMTQTPLSLPVSLGDQASISCRSSQSLLYSNGNTYL
HWYLQKPGQSPKLLIYKLSNRFSGVPDRFSGSGSGTDFTLKISRVEAEDLGVYFCS
QSTHVPWTFGGGTKLEIKDGGGSGGGGSGGGGSSQITLKESGPGILQPSQTLSLTCS
FSGFSLTTYGIGVGWIRQPPGKGLEWLTHIWWNDNKYYNTALRSRLTISKDSSNN
QVLLKIANVDTADTATYYCLYGYTYWGQGTLVTVSAD 65. UCHL-1 VH I11SL12S (SEQ ID NO: 353)
Nucleotide sequence:
gggagctctcagattactctgaaagagtctggccctgggatcttgcagccctcccagaccctcagtcgacttgttctttctctgggttt
tcactgaccacttatggtataggagtaggttggattcgtcagcctccagggaagggtctggagtggctgacacacatttggtggaat
gataataagtactataacacagccctgaggagccggctcacaatctccaaggattcctccaacaaccaagtactcctcaagatcgc
caatgtggacactgcagataccgccacatactactgtctctacggctacacttactggggccaagggactctggtcactgtctctgct
gatca Amino acid sequence: (SEQ ID NO: 354)
(GSS)QITLKESGPGSSQPSQTLSLTCSFSGFSLTTYGIGVGWIRQPPGKGLEWLTHIW
WNDNKYYNTALRSRLTISKDSSNNQVLLKIANVDTADTATYYCLYGYTYWGQGT
LVTVSAD 66. UCHL-1 scFv VH L11S (SEQ ID NO: 355)
Nucleotide sequence:
gttgttaagcttgccgccatgaagttgcctgttaggctgttggtgctgatgttctggattcctgcttccatcagtgatgttgtgatgaccc
aaactccactctccctgcctgtcagtcttggagatcaggcctccatctcttgcagatctagtcagagccttctttacagtaatggaaac
acctatttacattggtacctgcagaagccaggccagtctccaaaactcctgatctacaaactttccaaccgattttctggggtcccaga
caggttcagtggcagtggatcagggacagatttcacactcaagatcagcagagtggaggctgaggatctgggagtttatttctgctc
tcaaagtacacatgttccgtggacgttcggtggaggcaccaagctggaaatcaaagatggcggtggctcggggcggtggtgatct
ggaggaggtgggagctctcagattactctgaaagagtctggccctgggagctcccagccctccagaccctcagtctgacttgttc
tttctctggttttcactgaccacttatggtataggagtaggttggattcgtcagcctccagggaagggtctggagtggctgacacac
atttggtggaatgataataagtactataacacagccctgaggagccggctcacaatctccaaggattcctccaacaaccaagtactc
ctcaagatcgccaatgtggacactgcagataccgccacatactactgtctctacggctacacttactggggccaagggactctggtc
actgtctctgctgatca Amino acid sequence (SEQ ID NO: 356):
MKLPVRLLVLMFWIPASISDVVMTQTPLSLPVSLGDQASISCRSSQSLLYSNGNTYL
HWYLQKPGQSPKLLIYKLSNRFSGVPDRFSGSGSGTDFTLKISRVEADLGVYFCS
QSTHVPWTFGGGTKLEIKDGGGSGGGGSGGGGSSQITLKESGPGSSQPSQTLSLTC
SFSGFSLTTYGIGVGWIRQPPGKGLEWLTHIWWNDNKYYNTALRSRLTISKDSSNN
QVLLKIANVDTADTATYYCLYGYTYWGQGTLVTVSAD 67. UCHL-1 scFv (SSS-S)H WCH2 WCH3 (SEQ ID NO: 357)
Nucleotide sequence:
gttgttaagcttgccgccatgaagttgcctgttaggctgttggtgctgatgttctggattcctgcttccatcagtgatgttgtgatgaccc
aaactccactctccctgcctgtcagtcttggagatcaggcctccatctcttgcagatctagtcagagccttctttacagtaatggaaac
acctatttacattggtacctgcagaagccaggccagtctccaaaactcctgatctacaaactttccaaccgattttctggggtcccaga
caggttcagtggcagtggatcagggacagatttcacactcaagatcagcagagtggaggctgaggatctgggagtttatttctgctc
tcaaagtacacatgttccgtggacgttcggtggaggcaccaagctggaaatcaaagatggcggtggctcggggcggtggtgatct
ggaggaggtgggagctctcagattactctgaaagagtctggccctgggagctcccagccctccagaccctcagtctgacttgttctt
tctctgggttttcactgaccacttatggtataggagtaggttggattcgtcagcctccagggaagggtctggagtggctgacacacat
ttggtggaatgataataagtactataacacagccctgaggagccggctcacaatctccaaggattcctccaacaaccaagtactcct
caagatcgccaatgtggacactgcagataccgccacatactactgtctctacggctacacttactggggccaagggactctggtca
ctgtctctgctgatcaggagcccaaatcttctgacaaaactcacacatccccaccgtcctcagcacctgaactcctgggtggaccgt
cagtcttcctcttccccccaaaacccaaggacacccctcatgatctcccggacccctgaggtcacatgcgtggtggtggacgtgagc
cacgaagaccctgaggtcaagttcaactggtacgtggacggcgtggaggtgcataatgccaagacaaagccgcgggaggagca
gtacaacagcacgtaccgtgtggtcagcgtcctcaccgtcctgcaccaggactggctgaatggcaaggagtacaagtgcaaggtc
tccaacaaagcccccagccccatcgagaaaaccatctccaaagccaaagggcagccccgagaaccacaggtgtacaccct
gcccccatcccgggatgagctgaccaagaaccaggtcagcctgacctgcctggtcaaaggcttctatcccagcgacatcgccgtg
gagtgggagagcaatgggcagccggagaacaactacaagaccacgcctcccgtgctggactccgacggctccttcttcctctac
agcaagctcaccgtggacaagagcaggtggcagcaggggaacgtcttctcatgctccgtgatgcatgaggctctgcacaaccact
acacgcagaagagcctctccctgtctccgggtaaatgatctaga Amino acid sequence (SEQ ID NO: 358):
MKLPVRLLVLMFWIPASISDVVMTQTPLSLPVSLGDQASISCRSSQSLLYSNGNTYL
HWYLQKPGQSPKLLIYKLSNRFSGVPDRFSGSGSGTDFTKISRVEAEDLGVYFCS
QSTHVPWTFGGGTKLEIKDGGGSGGGSGGGGSSQITLKESGPGILQPSQTLSLTCS
FSGFSLTTYGIGVGWIRGPPGKGLEWLTHIWWNDNKYYNTALRSLTISKDSSNN
QVLLKIANVDTADTATYYCLYGYTYWGQGTLVTVSADQEPKSSDKTHTSPPSSAP
ELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQ
PREPQVYTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGK 68. UCHL-1 scFv VHL11S (SSS-S)H WCH2 WCH3 (SEQ ID NO: 359)
Nucleotide sequence:
gttgttaagcttgccgccatgaagttgcctgttaggctgttggtgctgatgttctggattcctgcttccatcagtgatgttgtgatgaccc
aaactccactctccctgcctgtcagtcttggagatcaggcctccatctcttgcagatctagtcagagccttctttacagtaatggaaac
acctatttacattggtacctgcagaagccaggccagtctccaaaactcctgatctacaaactttccaaccgattttctggggtcccaga
caggttcagtggcagtggatcagggacagatttcacactcaagatcagcagagtggaggctgaggatctgggagtttatttctgctc
tcaaagtacacatgttccgtggacgttcggtggaggcaccaagctggaaatcaaagatggcggtggctcggggcggtggtgatct
ggaggaggtgggagctctcagattactctgaaagagtctggccctgggagctcccagccctccagaccctcagtctgacttgttc
tttctctggttttcactgaccacttatggtataggagtaggttggattcgtcagcctccagggaagggtctggagtggctgacacac
atttggtggaatgataataagtactataacacagccctgaggagccggctcacaatctccaaggattcctccaacaaccaagtactc
ctcaagatcgccaatgtggacactgcagataccgccacatactactgtctctacggctacacttactggggccaagggactctggtc
actgtctctgctgatcaggagcccaaatcttctgacaaaactcacacatccccaccgtcctcagcacctgaactcctgggtggaccg
tcagtcttcctcttccccccaaaacccaaggacacccctcatgatctcccggacccctgaggtcacatgcgtggtggtggacgtgag
ccacgaagaccctgaggtcaagttcaactggtacgtggacggcgtggaggtgcataatgccaagacaaagccgcgggaggagc
agtacaacagcacgtaccgtgtggtcagcgtcctcaccgtcctgcaccaggactggctgaatggcaaggagtacaagtgcaaggt
ctccaacaaagcccccagccccatcgagaaaaccatctccaaagccaaagggcagccccgagaaccacaggtgtacaccc
tgcccccatcccgggatgagctgaccaagaaccaggtcagcctgacctgcctggtcaaaggcttctatcccagcgacatcgccgt
ggagtgggagagcaatgggcagccggagaacaactacaagaccacgcctcccgtgctggactccgacggctccttcttcctcta
cagcaagctcaccgtggacaagagcaggtggcagcaggggaacgtcttctcatgctccgtgatgcatgaggctctgcacaacca
ctacacgcagaagagcctctccctgtctccgggtaaatgatctagaa Amino acid sequence (SEQ ID NO: 360):
MKLPVRLLVLMFWIPASISDVVMTQTPLSLPVSLGDQASISCRSSQSLLYSNGNTYL
HWYLQKPGQSPKLLIYKLSNRFSGVPDRFSGSGSGTDFTKLISRVEAEDLGVYFCS
QSTHPWTFGGGTKLEIKDGGGSGGGGSGGGGSSQITLKESGPGSSQPSQTLSLTC
SFSGFSLTTYGIGVGWIRQPPGKGLEWLTHIWWNDNKYYNTALRSRLTISKDSSNN
QVLLKIANVDTADTATYYCLYGYTYWGQGTLVTVSADQEPKSSDKTHTSPPSSAP
ELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQ
PREPQVYTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSPGK 69. 5B9 VH L11S (SEQ ID NO: 361)
Nucleotide sequence:
gggagctctcaggtgcagctgaagcagtcaggacctggctcagtgcagtcctcacagagcctgtccatcacctgcacagtctctg
gtttctcattaactacctatgctgtacactgggttcgccagtctccaggaaagggtctggagtggctgggagtgatatggagtggtgg
aatcacagactataatgcagctttcatatatccagactgagcatcaccaaggacgattccaagagccaagttttctttaaaatgaacagtc
tgcaacctaatgacacagccatttattactgtgccagaaatgggggtgataactacccttattactatgctatggactactgggggtcaa
ggaacctcagtcaccgtctcctcag Amino acid sequence (SEQ ID NO: 362):
(GSS)QVQLKQSGPGSVQSSQSLSITCTVSGFSLTTYAVHWVRQSPGKGLEWLGVI
WSGGITDYNAAFISRLSITKDDSKSQVFFKMNSLQPNDTAIYYCARNGGDNYPYY
YAMDYWGQGTSVTVSS 73. 5B9 VH L11S scFv (SEQ ID NO: 363)
Nucleotide sequence:
aggcttgccgccatgaggttctctgctcagcttctggggctgcttgtgctctggatccctggatccactgcagatattgtgatgacgca
ggctgcattctccaatccagtcactcttggaacatcagcttccatctcctgcaggtctagtaagagtctcctacatagtaatggcatca
cttatttgtattggtatctgcagaagccaggccagtctcctcagctcctgatttatcagatgtccaaccttgcctcaggagtcccagaca
ggttcagtagcagtgggtcaggaactgatttcacactgagaatcagcagagtgggagtgggatgtggggtgtttattactgtgctc
aaaatctagaacttccgctcacgttcggtgctgggaccaagctggagctgaaacgggggtggcggtggctcggccggtggtgggt
cgggtggcggcgggagctctcaggtgcagctgaagcagtcaggacctggctcagtgcagtcctcacagagcctgtccatcacct
gcacagtctctggtttctcattaactacctatgctgtacactgggttcgccagtctccaggaaagggtctggagtggctgggagtgat
atggagtggtggaatcacagactataatgcagctttcatatatccagactgagcatcaccaaggacgattccaagagccaagttttcttt
aaaatgaacagtctgcaacctaatgacacagccatttattactgtgccagaaatgggggtgataactacccttattactatgctatgga
ctactgggggtcaaggaacctcagtcaccgtctcctcag Amino acid sequence (SEQ ID NO: 364):
MRFSAQLLGLLVLWIPGSTADIVMTQAAFSNPVTLGTSASISCRSSKSLLHSNGITY
LYWYLQKPGQSPQLLIYQMSNLASGVPDRFSSSGSGTDFTLRISRVEAEDVGVYYC
AQNLELPLTFGAGTKLELKRGGGGSGGGGSGGGGSSQVQLKQSGPGSVQSSQSLSI
TCTVSGFSLTTYAVHWVRQSPGKGLEWLGVIWSGGITDYNAAFISRLSITKDDSKS
QVFFKMNSLQPNDTAIYYCARNGGDNYPYYYAMDYWGQGTSVTVSS 70. 5B9 scFv VIIL11S (SSS-S)H WCH2 WCH3 (SEQ ID NO: 365)
Nucleotide sequence:
aagcttgccgccatgaggttctctgctcagcttctggggctgcttgtgctctggatccctggatccactgcagatattgtgatgacgca
ggctgcattctccaatccagtcactcttggaacatcagcttccatctcctgcaggtctagtaagagtctcctacatagtaatggcatca
cttatttgtattggtatctgcagaagccaggccagtctcctcagctcctgatttatcagatgtccaaccttgcctcaggagtcccagaca
ggttcagtagcagtgggtcaggaactgatttcacactgagaatcagcagagtgggagtgggatgtggggtgtttattactgtgctc
aaaatctagaacttccgctcacgttcggtgctgggaccaagctggagctgaaacgggggtggcggtggctcggccggtggtgggt
cgggtggcggcgggagctctcaggtgcagctgaagcagtcaggacctggctcagtgcagtcctcacagagcctgtccatcacct
gcacagtctctggtttctcattaactacctatgctgtacactgggttcgccagtctccaggaaagggtctggagtggctgggagtgat
atggagtggtggaatcacagactataatgcagctttcatatatccagactgagcatcaccaaggacgattccaagagccaagttttcttt
aaaatgaacagtctgcaacctaatgacacagccatttattactgtgccagaaatgggggtgataactacccttattactatgctatgga
ctactgggggtcaaggaacctcagtcaccgtctcctctgatcaggagcccaaatcttctgacaaaactcacacatccccaccgtcct
agcacctgaactcctggggggaccgtcagtcttcctcttccccccaaaacccaaggacaccctcatgatctcccggacccctgagg
tcacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagccctcccagcccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatccaagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaatgatctagag Amino acid sequence (SEQ ID NO: 366):
MRFSAQLLGLLVLWIPGSTADIVMTQAAFSNPVTLGTSASISCRSSKSLLHSNGITY
LYWYLQKPGQSPQLLIYQMSNLASGVPDRFSSSGSGTDFTLRISRVEAEDVGVYYC
AQNLELPLTFGAGTKLELKRGGGGSGGGGSGGGGSSQVQLKQSGPGSVQSSQSLSI
TCTVSGFSLTTYAVHWVRQSPGKGLEWLGVIWSGGITDYNAAFISRLSITKDDSKS
QVFFKMNSLQPNDTAIYYCARNGGDNYPYYYAMDYWGQGTSVTVSSDQEPKSS
DKTHTSPPSSAPELLGGPSVFLFPPKPKDTLMISRTPEVTCVVVDVSHEDPEVKFNW
YVDQVEVHNAKTKPREEQYNSTYRVVSVLTVLHQDWLNGKEYKCKVSNKALPA
PIEKTISKAKGQPREPQVYTLPPSRDELTKNQVSLTCLVKGFYPSDIAVEWESNGQP
ENNYKTTPPVLDSDGSFFLYSKLTVDKSRWQQGNVFSCSVMHEALHNHYTQKSLS
LSPGK

76. 2H7 scFv VH L11S (SSS-S)H P238SCH2 WCH3 (SEQ ID NO: 367)
Nucleotide sequence:
```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagctgaaagatggcggtggctcgggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagcacag
cagcctgacatctgaagactctgcggtctatttctgtgcaagagtggtgtactatagtaactcttactggtacttcgatgtctggggcac
agggaccacggcaccgctcttctgatcaggagcccaaatcttctgacaaaactcacacatcccccaccgtcctcagcacctgaact
cctgggggatcgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga
```

Amino acid sequence (SEQ ID NO: 368):
MDFQVQIFSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSSDK
THTSPPSSAPELLGGSSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK

78. 2H7 scFv VR L11S (SSS-S)H WCH2 WCH3 (SEQ ID NO: 369)
Nucleotide sequence:
```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagctgaaagatggcggtggctcgggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttctgacaaaactcacacatcccccaccgtcctcagcacctgaact
cctgggggaccgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccttctccgggtaaatgatctaga
```

Amino acid sequence (SEQ ID NO: 370):
MDFQVQIFSFLLISASVIIARGQIVLSQSPAILSASPGEKVTMTCRASSSVSYMHIWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSS
TAYMQLSSLTSEDSAVYFCARVVYYSNSYWYFDVWGTGTTVTVSSDQEPKSSDK
THTSPPSSAPELLGGPSVFLFPPKPKDTLMISRTPEVTCVVVSHEDPEVKFNWYV
DGVEVHNAKTKPREEQYNSTYRVVSVLTVLHQDWLNGKEYKCKVSNKALPAPPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK

79. 2H7 scFv VH L11S (CSS-S)H WCH2 WCH3 (SEQ ID NO: 371)
Nucleotide sequence:
```
aagcttgccgccatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccatccaacctggcttctggagtccctgctcgcttcagtg
gcagtgggtctgggacctcttactctctcacaatcagcgagtggaggctgaagatgctgccacttattactgccagcagtggagttt
taacccacccacgttcggtgctgggaccaagctggagctgaaagatggcggtggctcgggcggtggtggatctggaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaatggattggagctatttatccaggaaat
ggtgatacttcctacaatcagaagttcaagggcaaggccacactgactgtagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatcaggagcccaaatcttgtgacaaaactcacacatcccccaccgtcctcagcacctgaact
cctgggggaccgtcagcttcctcttccccccaaaacccaaggacaccctcatgatctcccggacccctgaggtcacatgcgtgg
```

-continued

```
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagcccctcccagcccccatcgagaaaacaatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaatgatctaga
```

Amino acid sequence (SEQ ID NO: 372):
MDFQVQIFSFSLLISFLLISASVIIARGQUVLSQSPAILSPAILSASPGEKVYMTCRASSSVSYMHWY
QQKPGSSPKPWIYAPSNLASGVPARFSGSGSTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDQEPKSCDDK
THTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNAKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMEALHNHYTQKSLSLS
PGK 77. G8-1 scFv VHL11S (SCS-S)H WCH2 WCH3 (SEQ ID NO: 373)
Nucleotide sequence:
```
gttgttaagcttgccgccatggtatccacagctcagttcctggggttgctgctgctgtggcttacaggcagatgtgacatccagat
gactcagtctccagcctccctatctgcatctgtgggagagactgtcaccatcacatgtcgaagtgaaaatgtttacagttatttgg
cttggtatcagcagaaacagggaaaatctcctcagctcctggtctcttttgcaaaaaccttagcagaaggtgtgccatcaaggttcag
tggcagtggatcaggcacagttttctctgaagatcagcacattgcagcctgaagattctggaagttattctgtcaacatcattccg
ataatccgtggacgttcggtggaggcaccgaactggagatcaaaggtggcggtggctcggggggtggtgggtcggggtggcggc
ggatcgtcagcggtccagctgcagcagtctggacctgagtcggaaaagcctggcgcttcagtgaagattcctgcaaggcttctgg
ttactcattcactggctacaatatgaactgggtgaagcagaataatggaaagagccttgagtggattggaaatattgatccttattatg
gtggtacttacctacaaccggaagttcaaggggcaaggccacattgactgtagacaaatcctccagcacagcctacatgcagctcaa
gagtctgacatctgaggactctgcagtctattactgtgcaagatcggtcggccctatggactggggtcaaggaacctcsgtcac
cgtctcttctgatcaggagcccaaatcttctgacaaaactcacacatgcccaccgtcctcagcacctgaactcctgggtggaccgtc
agtcttcctcttccccccaaaacccaaggacaccctcatgatctcccggacccctgaggtcacatgcgtggtggtggacgtgagcc
acgaagaccctgaggtcaagttcaactggtacgtggacggcgtggaggtgcataatgccaagacaaagccgcgggaggagca
gtacaacagcacgtaccgtgtggtcagcgtcctcaccgtcctgcaccaggactggctgaatggcaaggagtacaagtgcaaggtc
tccaacaaagcccctccagcccccatcgagaaaacaatctccaaagccaaagggcagccccgagaaccacaggtgtacccct
gcccccatcccgggatgagctgaccaagaaccag~cagcctgacctgcctg~c~aggcftctatccaagcgacatcgcc~g
gccccatcccgggatgagctgaccaagaaccaggtcagcctgacctgcctggtcaaaggcttctatccaagcgacatcgccgtg
gagtgggagagcaatgggcagccggagaacaactacaagaccacgcctcccgtgctggactccgacggctccttcttcctctac
agcaagctcaccgtggacaagagcaggtggcagcaggggaacgtcttctcatgctccgtgatgcatgaggctctgcacaaccact
acacgcagaagagcctctccctgtctccgggtaaatgatctagag
```

Amino acid sequence (SEQ ID NO: 374):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKSSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQEPKSSDKTHTCPPSS
APELLGGPSVFLFPPKPKDTLMISRTPEVTCVVVDVSHEDPEVKFNWYVDGVEVH
NAKTKPREEQYNSTYRVVSVLTVLHQDWLNGKWYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK 79.. G28-1 scFv VHL11S (CCS-P)H WCH2 WCH3 (SEQ ID NO: 375)
Nucleotide sequence:
```
gttgttaagcttgccgccatggtatccacagctcagttcctggggttgctgctgctgtggcttacaggtggcagatgtgacatccagat
gactcagtctccagcctccctatctgcatctgtgggagagactgtcaccatcacatgtcgaacaagtgaaaatgtttacagttatttgg
cttggtatcagcagaaacagggaaaatctcctcagctcctggtctcttttgcaaaaaccttagcagaaggtgtgccatcaaggttcag
tggcagtggatcaggcacagttttctctgaagatcagcacattgcagcctgaagattctggaagttattctgtcaacatcattccg
ataatccgtggacgttcggtggaggcaccgaactggagatcaaaggtggcggtggctcggggggtggtgggtcggggtggcggc
ggatcgtcagcggtccagctgcagcagtctggacctgagtcggaaaagcctggcgcttcagtgaagattcctgcaaggcttctgg
ttactcattcactggctacaatatgaactgggtgaagcagaataatggaaagagccttgagtggattggaaatattgatccttattatg
gtggtacttacctacaaccggaagttcaaggggcaaggccacattgactgtagacaaatcctccagcacagcctacatgcagctcaa
gagtctgacatctgaggactctgcagtctattactgtgcaagatcggtcggccctatggactactgggtcaaggaacctcagtcac
cgtctcttctgatcaggagcccaaatcttgtgacaaaactcacacatgcccaccgtcccagcacctgaactcctgggtggaccgtc
agtcttcctcttccccccaaaacccaaggacaccctcatgatctcccggacccctgaggtcacatgcgtggtggtggacgtgagcc
acgaagaccctgaggtcaactggtacgtggacggcgtggaggtgcataatgccaagacaaagccgcgggaggagca
gtacaacagcacgtaccgtgtggtcagcgtcctcaccgtcctgcaccaggactggctgaatggcaaggagtacaagtgcaaggtc
tccaacaaagcccctccagcccccatcgagaaaacaatctccaaagccaaagggcagccccgagaaccacaggtgtacaccct
gcccccatcccgggatgagctgaccaagaaccaggtcagcctgacctgcctggtcaaaggcttctatccaagcgacatcgccgtg
gagtgggagagcaatgggcagccggagaacaactacaagaccacgcctcccgtgctggactccgacggctccttcttcctctac
agcaagctcaccgtggacaagagcaggtggcagcaggggaacgtcttctcatgctccgtgatgcatgaggctctgcacaaccact
acacgcagaagagcctctccctgtctccgggtaaatgatctaga
```

Amino acid sequence (SEQ ID NO: 376):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQEPKSCDKTHTCPPS

```
PAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTP
PVLDSDGSFFLYSKLTVDKSRWQQGNVFSCSVMHEALHNHYTQKSLSLSPGK
```

80. G28-1 scFv VH L11S (SCC-P)H WCH2 WCH3 (SEQ ID NO: 377)
Nucleotide sequence:
```
gttgttaagcttgccgccatggtatccacagctcagttccttgggttgctgctgctgtggcttacaggtggcagatgtgacatccagat
gactcagtctccagcctccctatctgcatctgtgggagagactgtcaccatcacatgtcgaacaagtgaaaatgtttacagttatttgg
cttggtatcagcagaaacagggaaaatctcctcagcctggtctcttttgcaaaaaccttagcagaaggtgtgccatcaaggttcag
tggcagtggatcaggcacacagttttctctgaagatcagcagcctgcagcctgaagattctggaagttatttctgtcaacatcattccg
ataatccgtggacgttcggtggaggcaccgaactggagatcaaaggtggcggtggctcgggcggtggtgggtcgggtggcggc
ggatcgtcagcggtccagctgcagcagtctggacctgagtcggaaaagcctggcgcttcagtgaagatttcctgcaaggcttctgg
ttactcattcactggctacaatatgaactgggtgaagcagaataatggaaagagccttgagtggattggaaatattgatccttattatg
gtggtactacctacaaccggaagttcaagggcaaggccacattgactgtagacaaatcctccagcacagcctacatgcagctcaa
gagtctgacatctgaggactctgcagtctattactgtgcaagatcggtcggccctatggactactgggtcaaggaacctcagtcac
cgtctcttctgatcaggagcccaaatcttctgacaaaactcacacatgcccaccgtgcccagcacctgaactcctgggtggaccgtc
agtcttcctcttcccccaaaaccccaaggacaccctcatgatctcccggaccctgaggtcacatgcgtggtggtggacgtgagcc
acgaagaccctgaggtcaagttcaactggtacgtggacggcgtggaggtgcataatgccaagacaaagccgcgggaggagca
gtacaacagcacgtaccgtgtggtcagcgtcctcaccgtcctgcaccaggactggctgaatggcaaggagtacaagtgcaaggtc
tccaacaaagcccccagccccatcgagaaaacaatctccaaagccaaagggcagccccgagaaccaggtgtacaccctg
cccccatcccgggatgagctgaccaagaaccaggtcagcctgacctgcctggtcaaaggcttctatcccagcgacatcgccgtg
gagtgggagagcaatgggcagccggagaacaactacaagaccacgcctcccgtgctggactccgacggctccttcttcctctac
agcaagctcaccgtggacaagagcaggtggcagcaggggaacgtcttctcatgctccgtgatgcatgaggctctgcacaaccact
acacgcagaagagcctctccctgtctccgggtaaatgatctaga
```

Amino acid sequence (SEQ ID NO: 378):
```
MVSTAQFLGLLLLWLTGGRCDIQMTQSPASLSASVGETVTITCRTSENVYSYLAW
YQQKQGKPQLLVSFAKTLAGVPSRFSGSGSGTQFSLKISSLQPEDSGSYFCQKHS
DNPWTFGGGTELEIKGGGGSGGGGSGGGGSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDQEPKSSDKTHTCPPC
PAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTP
PVLDSDGSFFLYSKLTVDKSRWQQGNVFSCSVMHEALHNHYTQKSLSLSPGK
```

81. G28-1 scFv VH L11S mIgE CH2 CH3 CH4 (SEQ ID NO: 379)
Nucleotide sequence:
```
aagcttgccgccatggtatccacagctcagttccttgggttgctgctgctgtggcttacaggtggcagatgtgacatccagatgactc
agtctccagcctccctatctgcatctgtgggagagactgtcaccatgtcgaacaagtgaaaatgtttacagttatttggcttggt
atcagcagaaacagggaaaatctcctcagcctggtctcttttgcaaaaaccttagcagaaggtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttatggtggt
actacctacaaccggaagttcaagggcaaggccacattgactgtagacaaatcctccagcacagcctacatgcagctcaagagtct
gacatctgaggactctgcagtctattactgtgcaagatcggtcggccctatggactactgggtcaaggaacctcagtcaccgtctc
ttctgatcacgttcgacctgtcaacatcactgagcccaccttggagctactccattcatcctgcgacccaatgcattccactccacca
tccagctgtactgcttcatttatggccacatcctaaatgatgtctctgtcagctggctaatggacgatcgggagataactgatacacttg
cacaaactgttctaatcaaggaggaaggcaaactagcctctacctgcagtaaactcaatatcactgagcaatggatgtctgaa
agcaccttcacctgcaaggtcacctcccaaggcgtagactatttggcccacactcggagatgcccagatcatgagccacgggtg
tgattacctacctgatcccacccagccccctggacctgtatcaaaacggtgctcccaagcttacctgtctggtggtggacctggaaa
gcgagaagaatgtcaatgtgacgtggaaccaagagaagaagacttcagtctcagcatcccagtggtacactaagcaccacaataa
cgccacaactagtatcacctccatcctgcctgtagttgccaaggactggattgaaggctacggctatcagtgcatagtgaccacc
tgatttccaagcccattgtgcgttccatcaccaagacccaggcccagcctcagccccgaggtatatgtgttcccaccacccaga
ggaggagagcgaggacaaacgcacactcacctgttttgatccagaacttccctgaggatatctgtgcaggctggggatg
gcaaactgatctcaaacagccagcacagtaccacaacacccctgaaatccaatggctccaatcaaggcttcatcttcagtcgcc
tagaggtcgccaagacactctggacacagagaaaacagttcacctgccaagtgatccatgaggcacttcagaaacccaggaaact
gggagaaaacaatatccacaagccttggtaacacctccctccgtccatcctagaatctagagg
```

Amino acid sequence (SEQ ID NO: 380):
```
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDHVRPVNITEPTLELLH
SSCDPNAFHSTIQLYCFIYGHILNDVSWLMDDREITDTLAQTVLIKEEGKLASTC
SKLNITEQQWMSESTFTCKVTSQGVDYLAHTRRCPDHEPRGVITYLIPPSPLDLYQ
NGAPKLTCLVVDLESEKNVNVTWNQEKKTSVSASQWYTKAHHNNATTSITSILPVV
AKDWIEGYGYQCIVDHPDFPKPIVRSITKTPGQRSAPEVYVFPPPEEESEDKRTLTC
LIQNFFPEDISVQWLGDGKLISNSQHSTTTPLKSNGSNQGFFIFSRLEVAKTLWTQR
KQFTCQVIHEALQKPRKLEKTISTSLGNTSLRPS
```

82. G28-1 scFv VH L11S mIgA WH WCH2 T4CH3 (SEQ ID NO: 381)
Nucleotide sequence:
```
aagcttgccgccatggtatccacagctcagttccttgggttgctgctgctgtggcttacaggtggcagatgtgacatccagatgactc
agtctccagcctccctatctgcatctgtgggagagactgtcaccatcacatgtcgaacaagtgaaaatgtttacagttatttggcttggt
atcagcagaaacagggaaaatctcctcagcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
```

-continued

```
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgssgstttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaagagtct
gacatctgaggactctgcagtctattactgtgcaagatcggtcggccctatggactactggggtcaaggaacctcagtcaccgtctc
ttctgatcacatctgttctcctcctactactcctcctccaccttcctgccagcccagcctgtcactgcagcggccagctcttgaggacct
gctcctgggttcagatgccagcatcacatgtactctgaatggcctgagagatcctgagggagctgtcttcacctgggagccctccac
tgggaaggatgcagtgcagaagaaagctgtgcagaattcctgcgcgctgctacagtgtgtccagcgtcctgcctggctgtgctgag
cgctggaacagtggcgcatcattcaagtgcacagttaccccatcctgagtctgacaccttaactggcacaagccaaagtcacagtg
aacacctttccaccccaggtccacctgctaccgcgccgtcggaggagctggccctgaatgagctcgtgtccctgacatgcctgg
tgcgagctttcaaccctaaagaagtgctggtgcgatggctcatggaaatgaggagctgtcccccagaaagctacctagtgtttgag
cccctaaaggagccaggcgagggagccaccacctacctggtgacaagcgtgttgcgtgtatcagctgaaatctggaaacagggt
gaccagtactcctgcatggtgggccacgaggccttgcccatgaacttcacccagaagaccatcgaccgtctgtcgggtaaaccca
ccaatgtcagcgctgtgatcatgtcagagggagattgataatctagat
```

Amino acid sequence (SEQ ID NO: 382):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDHICSPPPPPSCQPS
LSLQRPALEDLLLGSDASITCTLNGLRDPEGAVFTWEPSTGKDAVQKKAVQNSCSG
CYSVSSVLPGCAERWNSGASFKCTVTHPESDTLTGTIAKVTVNTFPPQVHLLPPPSE
ELALNELVSLTCLVRAFNPKEVLVRWLHGNEELSPESYLVFEPLKEPGEGATTYLV
TSVLRVSAEIWKQGDQYSCMVGHEALPMNFTQKTIDRLSGKPTNVSVSVIMSEGD 83. G28-1 scFv Vh L11S hIgE CH2 CH3 CH4 (SEQ ID NO: 383)
Nucleotide sequence:
```
aagcttgccgccatggtatccacagctcagttccttgggttgctgctgctgtggcttacaggtggcagatgtgacatccagatgactc
agtctccagcctcccctatctgcatctgtgggagagactgtcaccatcacatgtcgaacaagtgaaatgtttacagttattggcttggt
atcagcagaaacagggaaaatctcctcagctcctggtctcttttgcaaaaaccttagcagaaggtgtgccatcaaggttcagtggca
gtggatcaggcacacagttttctctgaagatcagcagcctgcagcctgaagattctggaagttatttctgtcaacatcattccgataat
ccgtggacgttcggtggaggcaccgaactggagatcaaaggtggcggtggctcgggcggtggtgggtcgggtggcggcggat
cgtcagcggtccagctgcagcagtctggacctgagtcggaaaagcctggcgcttcagtgaagatttcctgcaaggcttctggttact
cattcactggctacaatatgaactgggtgaagcagaataatggaaagagccttgagtggattggaaatattgatccttattatggtggt
actacctacaaccggaagttcaagggcaaggccacattgactgtagacaaatcctccagcacagcctacatgcagctcaagagtct
gacatctgaggactctgcagtctattactgtgcaagatcggtcggccctatggactactggggtcaaggaacctcagtcaccgtctc
ttctgatcacgtctgctccagggacttcacccgcccaccgtgaagatcttcagtgtcctgcgacggcggcgggcacttcccc
cgaccatccagctcctgtgcctcgtctctgggtacacccaggactatcaacatcacctggctggaggacgggcaggtcatgga
cgtggacttgtccaccgcctctaccacgcaggagggtgagctggcctccacaaagcgagctcaccctcagcagaagcactg
gctgtcagaccgcacctacacctgccaggtcacctatcaaggtcacaccttgaggacagcaccaagtgtgcagattccaac
ccgagaggggtgagcgctcacctaagccggcccagcccgttcgacctgttcatccgcagactcgcccacgatcacctgtctggtgg
tggacctggcaccagcaaggggaccgttgaacctgacctggtcccgggcagtgggaagcctgtgaaccactccaccagaaag
gaggagaagcagcgcgcaatgcacgttaaccgtcacgtccaccctgccggtgggcaccgagactggatcgagggggagacct
accagtgcagggtgacccaccccacctgcccagggccctcatgcggtccacgaccaagaccagcgggcccgcgtgctgcccc
ggaagtctatgcgtttgcgacgccggagtggccggggagccgggacaagcgcaccctcgcctgcctgatccagaacttcatgcc
tgaggacatcctggtgcagtggctgcacaacgaggtgcagctcccggaccgccagcacgacgcagccccgcaagacc
aagggctccggcttcttcgtcttcagccgcctggaggtgaccgaggccgaatggagcagagaagatgagttcatctgccgtgcag
tccatgaggcagcgagccctcacagaccgtccagcgagcggtgtctgtaaatcccggtaaatgataatctaga
```

Amino acid sequence (SEQ ID NO: 384):
MVSTAQFLGLLLLWLTGGRCDIQMTQSPASLSASVGETVTITCRTSENVYSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMNWVKQNNGKSLEWIGNIDPYYGGTTYNRKFKGKATLTVDKSSST
AYMQLKSLTSEDSAVYYCARSVGPMDYWGQGTSVTVSSDHVCSRDFTPPTVKIL
QSSCDGGGHFPPTIQLLCLVSGYTPGTINITWLEDGQVMDVDLSTASTTQEGELAS
TQSELTLSQKHWLSDRTYTCQVTYQHTFEDSTKKCADSNPRGVSAYLSRPSPED
LFIRKSPTITCLVVDLAPSKGTVNLWSRASGKPVNHSTRKEEKQRNGTLTVTSTLP
VGTRDWIEGETYQCRVTHPHLPRALMRSTTKTSGPRAAPEVYAFATPEWPGSRDK
RTLACLIQNFMPEDISVQWLHNEVQLPDARHSTTQPRKTKGSGFFVFSRLEVTRAE
WEQKDEFICRAVHEAASPSQTVQTVQRAVSVNPGK 84. G28-1 scFv VH L11S hIgA WH WCH2 T4CH3 (SEQ ID NO: 385)
Nucleotide sequence:
```
atggtatccacagctcagctcagttccttgggttgctgctgctgtggcttacaggtggcagatgtgacatccagatgactcagtctccagcct
ccctatctgcatctgtgggagagactgtcaccatcacatgtcgaacaagtgaaatgtttacagttattggcttggtatcagcagaaa
cagggaaaatctcctcagctcctggtctcttttgcaaaaaccttagcagaaggtgtgccatcaaggttcagtggcaggtggatcaggc
acacagttttctctgaagatcagcagcctgcagcctgaagattctggaagttatttctgtcaacatcattccgataatccgtggacgttc
ggtggaggcaccgaactggagatcaaaggtggcggtggctcgggcggtggtgggtcgggtggcggcggatcgtcagcggtcc
agctgcagcagtctggacctgagtcggaaaagcctggcgcttcagtgaagatttcctgcaaggcttctggttactcattcactggcta
caatatgaactgggtgaagcagaataatggaaagagccttgagtggattggaaatattgatccttattatggtggtactacctacaac
cggaagttcaagggcaaggccacattgactgtagacaaatcctccagcacagcctacatgcagctcaagagtctgacatctgagg
actctgcagtctattactgtgcaagatcggtcggccctatggactactggggtcaaggaacctcagtcaccgtctcttctgatcagcc
agttccctcaactccacctaccctgtccctcaactccacctacccatctccctcatgctgccacccgactgtcactgcaccga
ccgggccctcgaggacctgctcttaggttcagaagcgatcctcacgtgcactctgaatggcctgagagatcctcaggtgcaccttt
cacctggacgccctcaagtgggaagcgctgttcaaggaccaccctgaccgtgacctctgtgctgctacagcgtgtccagtgtc
ctgccgggctgtgccgagccatggaaccatgggaagaccttcacttgcactgctgcctaccccgagtccaagaccccgctaaccg
ccaccctctcaaaatccggaaacacattccggcccgaggtccacctgctgccgccgcctcggaggagctggccctgaacgag
ctggtgacgctgacgtgcctggcacgtggcttcagccccaaggatgtgctggttcgctggctgcaggggtcacaggagctgccc
```

-continued
gcgagaagtacctgacttgggcatccggcaggagcccagccagggcaccaccaccttcgctgtgaccagcatactgcgcgtg
gcagccgaggactggaagaagggggacacctictcctgcatggtgggccacgaggccctgccgctggccttcacacagaagac
catcgaccgcttggcgggtaaacccacccatgtcaatgtgtctgttgtcatggcggaggtggactgataatctaga Amino acid sequence (SEQ ID NO: 386):
MVSTAQFLGLLLLWLTGGRCDIQMTQSPASLSASVGETVTITCRTSENVYTSYLAW
YQQKQGKSPQLLVSFAKTLAEGVPSRFSGSGSGTQFSLKISSLQPEDSGSYFCQHHS
DNPWTFGGGTELEIKGGGGSGGGGSGGGGSSAVQLQQSGPESEKPGASVKISCKA
SGYSFTGYNMMVKQNNGKSLEWIGNIDPYYGGTTYNRKFKGKATLTVDKSSST
AYMQLKSLTSEDSAVYYCARSVGPMDYWGQGTSVTVSSDQPVPSTPPTPSPSTPPT
PSPSCCHPRLSLHRPALED 85. HD37 VL (SEQ ID NO: 387)
Nucleotide sequence:
aagcttgccgccatggagacagacacactcctgctatgggtgctgctgctctggttccaggctccactggtgacattgtgctgacc
caatctccagcttctttggctgtgtctctagggcagagggccaccatctcctgcaaggccagccaaagtgattatgatggtgata
gttatttgaactggtaccaacagattccaggacagccacccaaactcctcatctatgatgcatccaatctagtttctgggatcccaccc
aggttagtggcagtgggtctgggacagacttcaccctcaacatcctgtgggagaaggatgctgcaacctatcactgtcag
caaagtactgaggatccgtggacgttcggtggaggcaccaagctggaaatcaaaggtggcggtggctcgggcggtggtgggtc
gggtggcggcgggagctcg Amino acid sequence (SEQ ID NO: 388):
METDTLLLWVLLLWVPGSTGDIVLTQSPASLAVSLGQPATISCKASQSVDYDGDS
YLNWYQQIPGQPPKLLIYDASNLVSGIPPRFSGSGSGTDFTLNIHPVEKVDAATYHC
QQSTEDPWTFGGGTKLEIKGGGGSGGGGSGGGGSS 86. HD37 VH (SEQ ID NO: 389)
Nucleotide sequence:
gggagctcgcaggttcagctgcagcagtctggggctgagctggtgaggcctgggtcctcagtgaagatttcctgcaaggcttctg
gctatgcattcagtagctactggatgaactgggtgaagcagaggcctggacaggtcttgagtggattggacagatttggcctgga
gatggtgatactaactacaatggaaagttcaagggtaaagccactctgactgcagacgaatcctccagcacagcctacatgcaact
cagcagcctagcatctgaggactctgcggtctatttctgtgcaagacgggagactacgacggtaggccgttattactatgctatgga
ctactggggtcaaggaacctcagtcaccgtctcctctgatcag Amino acid sequence (SEQ ID NO: 390):
(GSS)QVQLQQSGAELVRPGSSVKISCKASGYAFSSYWMNWVKQRPGQGLEWIGQI
WPGDGDTNYNGKFKGKATLTADESSSTAYMQLSSLASEDSAVYFCARRETTTVG
RYYYAMDYWGQGTSVTVSSDQ 87. HD37 scFv (SEQ ID NO: 391)
Nucleotide sequence:
aagcttgccgccatggagacagacacactcctgctatgggtgctgctgctctggttccaggctccactggtgacattgtgctgacc
caatctccagcttctttggctgtgtctctagggcagagggccaccatctcctgcaaggccagccaaagtgtgttgattatgatggtgata
gttatttgaactggtaccaacagattccaggacagccacccaaactcctcatctatgatgcatccaatctagtttctgggatcccaccc
aggtttagtggcagtgggtctgggacagacttcaccctcaacatcctgtgggagaaggtggatgctgcaacctatcactgtcag
caaagtactgaggatccgtggacgttcggtggaggcaccaagctggaaatcaaaggtggcggtggctcgggcggtggtgggtc
gggtggcggcggatcgtcacaggttcagctgcagcagtctggggctgagctggtgaggcctgggtcctcagtgaagatttcctgc
aaggcttctggctatgcattcagtagctactggatgaactgggtgaagcagaggcctggacaggtcttgagtggattggacagatt
tggcctggagatggtgatactaactacaatggaaagttcaagggtaaagccactctgactgcagacgaatcctccagcacagccta
catgcaactcagcagcctagcatctgaggactctgcggtctatttctgtgcaagacgggagactacgacggtaggccgttattacta
tgctatggactactggggtcaaggaacctcagtcaccgtctcctctgatcag Amino acid sequence (SEQ ID NO: 329):
METDTLLLWVLLLWVPGSTGDIVLTQSPASLAVSLGQRATISCKASQSQSVDYDGDS
YLNYQQIPGQPPKLLIYDASNLVSGIPPRFSGSGSGTDFTLNIHPVEKVDAATYHC
QQSTEDPWTFGGGTKLEIKGGGGSGGGGSGGGGSSQVQLQQSGAELVRPGSSVKI
SCKASGYAFSSYWNWVKQRPGQGLEWIGQIWPGDGDTNYNGKFKGKATLTAD
ESSSTAYMQLSSLASEDSAVYFCARRETTTVGRYYYAMDYWGQGTSVTVSSDQ 88. HD37 VHL11S (SEQ ID NO: 393):
Nucleotide sequence:
gggagctcgcaggttcagctgcagcagtctggggctgagtcggtgaggcctgggtcctcagtgaagatttcctgcaaggcttctg
gctatgcattcagtagctactggatgaactgggtgaagcagaggcctggacaggtcttgagtggattggacagatttggcctgga
gatggtgatactaactacaatggaaagttcaagggtaaagccactctgactgcagacgaatcctccagcacagcctacatgcaact
cagcagcctagcatctgaggactctgcggtctatttctgtgcaagacgggagactacgacggtaggccgttattactatgctatgga
ctactggggtcaaggaacctcagtcaccgtctcctctgatcag Amino acid sequence (SEQ ID NO: 394):
(GSS)QVQLQQSGAESVRPGSSVKISCKASGYAFSSYWMNWVKQRPGQGLEWIGQI
WPGDGDTNYNGKFKGKATLTADESSSTAYMQLSSLASEDSAVYFCARRETTTVG
RYYYAMDYWGQGTSVTVSSDQ 89. HD37 scFv VHL11S (SEQ ID NO: 395):
Nucleotide sequence:
Aagcttgccgccatggagacagacacactcctgctatgggtgctgctgctctggttccaggctccactggtgacattgtgctgac
ccaatctccagcttctttggctgtgtctctagggcagagggccaccatctcctgcaaggccagccaaagtgttgattatgatggtgat
agttatttgaactggtaccaacagattccaggacagccacccaaactcctcatctatgatgcatccaatctagtttctgggatcccacc
agttatttgaactggtaccaacagattccaggacagccacccaaactcctcatctatgatgcatccaatctagtttctgggatcccacc
caggtttagtggcagtgggtctgggacagacttcaccctcaacatcctgtgggagaaggtggatgctgcaacctatcactgtca
gcaaagtactgaggatccgtggacgttcggtggaggcaccaagctggaaatcaaaggtggcggtggctcgggcggtggtggt -continued cgggtggcggcgggagctcgcaggttcagctgcagcagtctggggctgagtcggtgaggcctgggtcctcagtgaagatttcct
gcaaggcttctggctatgcattcagtagctactggatgaactgggtgaagcagaggcctggacagggtcttgagtggattggacag
atttggcctggagatggtgatactaactacaatggaaagttcaagggtaaagccactctgactgcagacgaatcctccagcacagc
ctacatgcaactcagcagcctagcatctgaggactctgcggtctatttctgtgcaagacgggagactacgacggtaggccgttatta
ctatgctatggactactgggtcaaggaacctcagtcaccgtctcctctgatcag Amino acid sequence (SEQ ID NO: 396):
METDTLLLWVLLLWVPGSTGDIVLTQSPASLAVSLGQRATISCKASQSVDYDGDS
YLNWYQQIPGQPPKLLIYDASNLVSGIPPRFSGSGSGTDFTLNIHPVEKVDAATYHC
QQSTEDPWTFGGGTKLEIKGGGSGGGGSGGGGSSQVQLQQSGAESVRPGSSVKI
SCKASGYAFSSYWMNWVKQRPGQGLEWIGQIWPGDGDTNYNGKFKGKATLTAD
ESSSTAYMQLSSLASEDSAVYFCARRTTTVGRYYYAMDYWGQGTSVTIVSSDQ 90. HD37 scFv IgAH hIgG1 WCH2 T4CH3 (SEQ ID NO: 397)
Nucleotide sequence
aagcttgccgccatggagacagacacactcctgctatgggtgctgctgctctgggttccaggctccactggtgacattgtgctgacc
caatctccagcttctttggctgtgtctctaggggcagagggccaccatctcctgcaaggccagccaaagtgttgattatgatggtgata
gttatttgaactggtaccaacagattccaggacagcaccccaaactcctcatctatgatgcatccaatctagtttctgggatcccaccc
aggtttagtggcagtgggtctgggacagacttcacccctcaacatccatcctgtggagaagggatgctgcaacctatcactgcag
caaagtactgaggatccgtggacgttcggtggaggcaccaagctggaaatcaaaggtggcggtggctcgggcggtggtgggtc
gggtggcggcgggagctcgcaggttcagctgcagcagtctggggctgagtcggtgaggcctgggtcctcagtgaagatttcctg
caaggcttctggctatgcattcagtagctactggatgaactgggtgaagcagaggcctggacagggtcttgagtggattggacaga
tttggcctggagatggtgatactaactacaatggaaagttcaagggtaaagccactctgactgcagacgaatcctccagcacagcct
acatgcaactcagcagcctagcatctgaggactctgcggtctatttctgtgcaagacgggagactacgacggtaggccgttattact
atgctatggactactgggtcaaggaacctcagtcaccgtctcctctgatcagttccctcaactccacctacccatctccctc
aactccacctaccccatctccctcatgctgccaccccgactgtcactgcaccgaccgccctcgaggacctgctcttaggttcaga
agcgatcctcacgtgcacactgaccggcctgagagatgcctcaggtgtcaccttcacctggacgccctcaagtgggaagagcgct
gttcaaggaccacctgaccgtgacctctgtggctgctacagcgtgtccagtgtcctgccgggctgtgccgagccatggaaccatg
ggaagaccttcacttgcactgctgcctaccccgagtccaagacccgctaaccgccaccctctcaaaatccggaaacacattccg
gcccgaggtccacctgctgccgccgccgtcggaggagctggtggaacgagctggtgacgtgcctgacgtgcctggcacgtggct
tcagccccaaggatgtgctggttcgctggctgcaggggtcacaggagctgccccgcgagaagtacctgacttgggcatcccggc
aggagcccagccagggcaccaccaccttcgctgtgaccagcatactgcgcgtggcagccgaggactggaagaaggggggacac
cttctcctgcatggtgggccacgaggccctgccgctggccttggccttcacacagaagaccatcgaccgcttggcgggtaaacccacccat
gtcaatgtgtctgttgtcatggcggaggtggactgataatctaga Amino acid sequence (SEQ ID NO: 398)
METDTLLLWVLLLWVPGSTGDIVLTQSPASLAVSLGQRATISCKASQSVDYDGDS
YLLNWYQQIPGQPPKLLIYDASNLVSGIPPRFSGSGSGTDFTLNIHPVEKVDAATYHC
QQSTEDPWTFGGGTKLEIKGGGSGGGGSGGGGSSQVQLQQSGAESVRPGSSVKL
SCKASGYAFSSYWNWVKQRPGQGLEWIGQIWPGDGDTNYNGKFKGKATLTAD
ESSSTAYMQLSSLASEDSAVYFCARRETTTVGRYYYAMDYWGQGTSVTVSSDQP
VPSTPPTPSPSTPPTPSPSCCHPRLSLHRPALEDLLLGSEAILTCTLTGLRDASGVTFT
WTPSSGKSAVQGPPDRDLCGCYSVSSVLPGCAEPWNHGKTFTCTAAYPESKTPLT
ATLSKSGNTFRPEVHLLPPPSEELALNELVTLTCLARGFSPKDVLVRWLQGSQELP
REKYLTWASRQEPSQGTTTFAVTSILRVAAEDWKKGDTFSCMVGHEALPLAFTQK
TIDRLAGKPTHVNVSVVMAEVD 91. HD37 scFv (SSS-S)H WCH2 WCH3 (SEQ ID NO: 399)
Nucleotide sequence:
aagcttgccgccatggagacagacacactcctgctatgggtgctgctgctctgggttccaggctccactggtgacattgtgctgacc
caatctccagcttctttggctgtgtctctaggggcagagggccaccatctcctgcaaggccagccaaagtgttgattatgatggtgata
gttatttgaactggtaccaacagattccaggacagcaccccaaactcctcatctatgatgcatccaatctagtttctggggatcccaccc
aggtttagtggcagtgggtctgggacagacttcacccctcaacatccatcctgtggagaaggtggatgctgcaacctatcactgtcag
caaagtactgaggatccgtggacgttcggtggaggcaccaagctggaaatcaaaggtggcggtggctcgggcggtggtgggtc
gggtggcggcggatcgtcacaggttcagctgcagcagtctggggctgagtcggtgaggcctgggtcctcagtgaagatttcctgc
aggcttctggctatgcattcagtagctactggatgaactgggtgaagcagaggcctggacagggtcttgagtggattggacagatt
tggcctggagatggtgatactaactacaatggaaagttcaagggtaaagccactctgactgcagacgaatcctccagcacagccta
catgcaactcagcagcctagcatctgaggactctgcggtctatttctgtgcaagacgggagactacgacggtaggccgttattacta
tgctatggactactgggtcaaggaacctcagtcaccgtctcctctgatcagtcctcaaatcttctgacaaaactcacacatcccc
accgtcctcagcacctgaactcctgggtggaccgtcagtcttcctcttccccccaaaacccaaggacaccctcatgatctcccggac
ccctgaggtcacatgcgtggtggtggacgtgagccacgaagaccctgaggtcaagttcaactggtacgtggacggcgtggaggt
gcataatgccaagacaaagccgcgggaggagcagtacaacagcacgtaccgtgtggtcagcgtcctcaccgtcctgcaccagg
actggctgaatggcaaggagtacaagtgcaaggtctccaacaaagccctcccagcccccatcgagaaaaccatctccaaagcca
aagggcagccccgagaaccacaggtgtacaccctgcccccatcccgggatgagctgaccaagaaccaggtcagcctgacctgc
ctggtcaaaggcttctatcccagcgacatcgccgtggagtgggagagcaatgggcagccggagaacaactacaagaccacgcc
tcccgtgctggactccgacggctccttcttcctctacagcaagctcaccgtggacaagagcaggtggcagcaggggaacgtcttct
catgctccgtgatgcatgaggctctgcacaaccactacacgcagaagagcctctccctgtctccgggtaaatgatctaga Amino acid sequence: (SEQ ID NO: 400)
METDTLLLWVLLLWVPGSTGDIVLTQSPASLAVSLGQRATISCKASQSVDYDGDS
YLNWYQQIPGQPPKLLIYDASNLVSGIPPRFSGSGSGTDFTLNIHPVEKVDAATYHC
QQSTEDPWTFGGGTKLEIKGGGSGGGGSGGGGSSQVQLQQSGAELVRPGSSVKI
SCKASGYAFSSYWMNWVKQRPGQGLEWIGQIWPGDGDTNYNGKFKGKATLTAD
ESSSTAYMQLSSLASEDSAVYFCARRETTTVGRYYYAMDYWGQGTSVTVSSDQE
PKSSDKTHTSPPSSAPELLGGPSVFLFPPKDTLMISRTPEVTCVVVDVSHEDPEV
KFNWYVDGVEVHNAKTKPREEQYNSTYRVVSVLTVLHQDWLNGKEYKCKVSNK
ALPAPIEKTISKAKGQPREPQVYTLPPSRDELTKNQVSLTCLVKGFYPSDIAVEWES
NGQPENNYKTTPPVLDSDGSFFLYSKLTVDKSRWQQGNVFSCSVMHEALHNHYT
QKISLSLSPGK -continued 92. HD37 scFv VH L11S (SSS-S)H WCH2 WCH3 (SEQ ID NO: 401)
Nucleotide sequence:
aagcttgccgccatggagacagacacactcctgctatgggtgctgctgctctggttccaggctccactggtgacattgtgctgacc
caatctccagcttctttggctgtgtctctagggcagagggccaccatctcctgcaaggccagccaaagtgttgattatgatggtgata
gttatttgaactggtaccaacagattccaggacagccaccaaactctcatctatgatgcatccaatctagtttctgggatcccaccc
aggtttagtggcagtgggtctgggacagacttcaccctcaacatccatcctgtggagaaggtggatgctgcaacctatcactgtcag
caaagtactgaggatccgtggacgttcggtggaggcaccaagctggaaatcaaaggtggcggtggctcgggcggtggtgggtc
gggtggcggcggagctcgcaggttcagctgcagcagtctggggctgagtcggtgaggcctggggtcctcagtgaagatttcctg
caaggcttctggctatgcattcagtagctactggatgactgggtgaagcaggctcagggaaggcttgagtggattggacaga
tttggcctggagatggtgatactaactacaatggaaagttcaaggtgtaaagccactctgactgcagacgaatcctccagcacagcct
acatgcaactcagcagcctagcatctgaggactctgcggtctatttctgtgcaagacgggagactacgacggtaggccgttattact
atgctatggactactggggtcaaggaacctcagtcaccgtctcctctgatcaggagcccaaatcttctgacaaaactcacacatccc
caccgtcctcagcacctgaactcctggggggaccgtcagtcttcctcttccccccaaaacccaaggacaccctcatgatctcccgg
acccctgaggtcacatgcgtggtggtggacgtgagccacgaagaccctgaggtcaagttcaactggtacgtggacggcgtggag
gtgcataatgccaagacaaagccgcgggaggagcagtacaacagcacgtaccgtgtggtcagcgtcctcaccgtcctgcaccag
gactggctgaatggcaaggagtacaagtgcaaggtctccaacaaagcctcccagcccccatcgagaaaacaatctccaagcc
aaagggcagccccgagaaccacaggtgtacaccctgcccccatcccgggatgagctgaccaagaaccaactacaagacccacgc
ctcccgtgctggactccgacggctccttcttcctctacagcaagctcaccgtggacaagagcaggtggcagcaggggaacgtcttc
tcatgctccgtgatgcatgaggctctgcacaaccactacacgcagaagagcctctccctgtctccgggtaaatgatctaga Amino acid sequence (SEQ ID NO: 402):
METDTLLLWVLLLWVPGSTGDIVLTQSPASLAVSLGQRATISCKASQSVDYDGDS
YLNWYQQIPGQPPKLLIYDASNLVSGIPPRFSGSGSGTDFTLNIHPVEKVDAATYHC
QQSTEDPWTFGGGTKLEIKGGGGSGGGGSGGGGSSQVQLQQSGAESVRPGSSVKI
SCKASGYAFSSYWMNWVKQRPGQGLEWIGQIWPGDGDTNYNGKFGKATLTAD
ESSSTAYMQLSSLASEDSAVYFCARRETTTVGRYYYAMDYWGQGTSVTVSSDQE
PKSSDKTHTSPPSSAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNK
ALPAPIEKTISKAKGQPREPQVYTLPPSRDELTKNQVSLTCLVKGFYPSDIAVEWES
NGQPENNYKTTPPVLDSDGSFFLYSKLTVDKSRWQQGNVFSCSVMHEALHNHYT
QKSLSLSPGK 91. L6 VL (SEQ ID NO: 403)
Nucleotide sequence:
atggattttcaagtgcagattttcagcttcctgctaatcagtgcttcagtcataatgtccagaggacaaattgttctctcccagtctccag
caatcctgtctgcatctccaggggagaaggtcacattgacttgcagggccagctcaagtgtaagtttcatgaactggtaccagcaga
agccaggatcctcccccaaaccctggatttatgccacatccaatttggcttctgagttccctggtcgcttcagtggcagtggtctgg
gacctcttactctctcgcaatcagcagagtggaggctgaagatgctgccacttattactgccagcagtggaatagtaaccactcac
gttcggtgctgggaccaagctggagctgaaagagctctctggtggcggtggctcgggcggtggtgggtcgggtggcggcggat
ct Amino acid sequence (SEQ ID NO: 404):
MDFQVQIFSFLLISASVIMSRGQIVLSQSPAILSASPGEKVTLTCRASSSVSFMNWTQ
QKPGSSPKPWIYATSNLASEFPGRFSGEWSGTSYSLAISRVEAEDAATYYCQQWNS
NPLTFGAGTKLELKELSGGGGSGGGGSGGGGGS 92. L6 VH (SEQ ID NO: 405)
Nucleotide sequence:
cagatccagttggtgcagtctggacctgagctgaagaagcctggagagacagtcaagatctcctgcaaggcttctgggtataccttc
acaaactatggaatgaactgggtgaagcaggctccaggaaagggtttaaagtggatgggctggataaacacctacactggaca
gccaacatatgctgatgacttcaagggacggtttgccttctcttggaaacctctgcctacactgcctatttgcagatcaacaacctca
aaaatgaggacatggctacatatttctgtgcaagatttagctatggtaactcacgttacgctgactactggggccaaggcaccactct
cacagtctcctctgatca Amino acid sequence (SEQ ID NO: 406):
QIQLVQSGPELKKPGETVKISCKASGYTFTNYGMNWVKQAPGKGLKWMGWINTY
TGQPTYADDFKGRFAFSLETSAYTAYLQINNLKNEDMATYFCARFSYGNSRYADY
WGQGTTLTVSSD 93. L6 scFv (SEQ ID NO: 407)
Nucleotide sequence:
atggattttcaagtgcagattttcagxttcctgctaatcagtgcttcagtcataatgtccagaggacaaattgttctctcccagtctccag
caatcctgtctgcatctccaggggagaaggtcacattgacttgcagggccagctcaagtgtaagtttcatgaactggtaccagcaga
agccaggatcctcccccaaaccctggatttatgccacatccaatttggcttctgagttccctggtcgcttcagtggcagtggtctgg
gacctcttactctctcgcaatcagcagagtggaggctgaagatgctgccacttattactgccagcagtggaatagtaaccactcac
gttcggtgctgggaccaagctggagctgaaagagctctctggtggcggtggctcgggcggtggtgggtcgggtggcggcggat
ctctgcagatccagttggtgcagtctggacctgagctgaagaagcctggagagacagtcaagatctcctgcaaggcttctgggtat
accttcacaaactatggaatgaactgggtgaagcaggctccaggaaagggtttaaagtggatgggctggataaacacctactg
gacagccaacatatgctgatgacttcaagggacggtttgccttctcttggaaacctctgcctacactgcctatttgcagatcaacaac
ctcaaaaatgaggacatggctacatatttctgtgcaagatttagctatggtaactaactcacttacgctgactactggggccaaggcacca
ctctcacagtctcctctgatca Amino acid sequence (SEQ ID NO: 408):
MDFQVQIFSFLLISASVIMSRGQIVLSQSPAILSASPGEKVTLTCRASSSVSFMNWYQ
QKPGSSPKPWIYATSNLASEFPGRFSGEWSGTSYSLAISRVEAEDAATYYCQQWNS
NPLTFGAGTKLELKELSGGGGSGGGGSGGGGSLQIQLVQSGPELKKPGETVKISCK
ASGYTFNYGMNWVKQAPGKGLKWMGWINTYTGQPTYADDFKGRFAFSLETSA
YTAYLQINNLKNEDMATYFCARFSYGNSRYADYWGQGTTLTVSSD -continued 94. L6 VHL11S (SEQ ID NO: 409)
Nucleotide sequence:
ctgcagatccagttggtgcagtctggacctgagtcgaagaagcctggagagacagtcaagatctcctgcaaggcttctgggtatac
cttcacaaactatggaatgaactgggtgaagcaggctccaggaaagggtttaaagtggatgggctggataaaacacctacactgga
cagccaacaatatgctgatgacttcaagggacggtttgccttctcttggaaacctctgcctacactgcctatttgcagatcaacaacct
caaaaatgaggacatggctacatatttctgtgcaagatttagctatggtaactcacgttacgctgactactggggccaaggcaccact
ctcacagtctcctctgatca Amino acid sequence (SEQ ID NO: 410):
QIQLVQSGPESKKPGETVKISCKASGYTPTNYGMNWVKQAPGKGLKWMGWINTY
TGQPTYADDFKGRFAFSLETSAYTAYLQINNLKNEDMATYFCARFSYGNSRYADY
WGQGTTLTVSSD 95. L6 VH L11S scFv (SEQ ID NO: 411)
Nucleotide sequence;
Aagcttgttgttatggattttcaagtgcagattttcagcttcctgctaatcagtgcttcagtcataatgtccagaggacaaattgttctctc
ccagtctccagcaatcctgtctgcatctccaggggagaaggtcacattgacttgcagggccagctcaagtgtaagtttcatgaactg
gtaccagcagaagccaggatcctcccccaaaccctggatttatgccacatccaatttggcttctgagttcctggtcgcttcagtggc
gagtggtctgggacctcttactctctcgcaatcagcagagtggaggctgaagatgctgccacttattactgccagcagtggaatagt
aacccactcacgttcggtgctgggaccaagctggagctgaaagagctctctggtggcggtggctcgggcggtggtgggtcggt
ggcggcggatctctgcagatccagttggtgcagtctggacctgagtcgaagaagcctggagagacagtcaagatctcctgcaag
gcttctgggtataccttcacaaactatggaatgaactgggtgaagcaggctccaggaaagggtttaaagtggatgggctggataaa
cacctacactggacagccaacatatgctgatgacttcaagggacggtttgccttctctttggaaacctctgcctacactgcctatttgc
agatcaacaacctcaaaaatgaggacatggctacatatttctgtgcaagatttagctatggtaactcacgttacgctgactactgggg
ccaaggcaccactctcacagtctcctctgatca Amino acid sequence (SEQ ID NO: 412):
MDFQVQTFSFLLISASVIMSRGQIVLSQSPAILSASPGEKVTLTCRASSSVSFMNWYQQ
QKPGSSPKPWIYATSNLASEFPGRFSGEWSGTSYSLAISRVEADAATYYCQQWNS
NPLTFGAGTKLELKELSGGGGSGGGGSGGGGSLQIQLVQSGPESKKPGETVKISCK
ASGYTFTNYGMNWVKQAPGKGLKWMGWINTYTGQPTYADDFKGRAFAFSLETSA
YTAYLQINNLKNEDMATYFCARFSYGNSRYADYWGQGTTLTVSSD 96. L6 Or L6 VHL11S scFv IgAH hIgG1 WCH2 WCH3 (SEQ ID NO: 413)
Nucleotide sequence: (L6 VHL11S is is shown)
aagcttgttgttatggattttcaagtgcagattttcagcttcctgctaatcagtgcttcagtcataatgtccagaggacaaattgttctctcc
cagtctccagcaatcctgtctgcatctccaggggagaaggtcacattgacttgcagggccagctcaagtgtaagtttcatgaactgg
taccagcagaagccaggatcctcccccaaaccctggatttatgccacatccaatttggcttctgagttcctggtcgcttcagtggcg
agtggtctgggacctcttactctctcgcaatcagcagagtggaggctgaagatgctgccacttattactgccagcagtggaatagta
acccactcacgttcggtgctgggaccaagctggagctgaaagagctctctggtggcggtggctcgggcggtggtgggtcgggtg
gcggcggatctctgcagatccagttggtgcagtctggacctgagtcgaagaagcctggagagacagtcaagatctcctgcaaggc
ttctgggtataccttcacaaactatggaatgaactgggtgaagcaggctccaggaaagggtttaaagtggatgggctggataaaaca
cctacactggacagccaacatatgctgatgacttcaagggacggtttgccttctctttggaaacctctgcctacactgcctatttgcag
atcaacaacctcaaaaatgaggacatggctacatatttctgtgcaagatttagctatggtaactcacgttacgctgactactggggcc
aaggcaccactctcacagtctcctctgatcagccagttccctcaactccacctaccccatctccctcaactccacctaccccatctcc
ctcatgcgcacctgaactcctgggggaccgtcagtcttcctcttccccccaaaacccaaggacacccctcatgatctcccggaccc
atcaacaacctcaaaaatgaggacatggctacatatttctgtgcaagatttagctatggtaactcacgttacgctgactactggggcc
aaggcaccactctcacagtctcctctgatcagccagttccctcaactccacctaccccatctccctcaactccacctaccccatctcc
ctcatgcgcacctgaactcctgggggaccgtcagtcttcctcttccccccaaaacccaaggacacccctcatgatctcccggaccc
ctgaggtcacatgcgtggtggtggacgtgagccacgaagacctgaggtcaagttcaactggtacgtggacggcgtggaggtgc
ataatgccaagacaaagccgcgggaggagcagtacaacagcacgtaccgtgtggtcagcgtcctcaccgtcctgcaccaggact
ggctgaatggcaaggagtacaagtgcaaggtctccaacaaagccctcccagcccccatcgagaaaacaatctccaaagccaaag
ggcagccccgagaaccacaggtgtacaccctgcccccatcccgggatgagctgaccaagaaccaggtcagcctgacctgcctg
gtcaaaggcttctatcccagcgacatcgccgtggagtgggagagcaatgggcagccggagaacaactacaagaccacgcctcc
cgtgctggactccgacggctccttcttcctctacagcaagctcaccgtggacaagagcaggtggcagcaggggaacgtcttctcat
gctccgtgatgcatgaggctctgcacaaccacracacgcagaagagcctctccctgtctccgggtaaatgatctaga Amino acid sequence (SEQ ID NO: 414):
MSFQVQIFSFFLLISASVIMSRGQIVLSQSPAILSASPGEKVTLTCRASSSVSFMNWYQ
QKPGSSPKPWIYATSNLASEFPGRFSGEWSGTSYSLAISRVEAEDAATYYCQQWNS
NPLTFGAGTKLELKELSGGGGSGGGGSGGGGSLQIQLVQSGPESKKPGETVKISCK
ASGYTFTNYGMNWVKQAPGKGLKWMGWINTYGQPTYADDFKGRFAFSLETSA
YTAYLQINNLKNEDMATYFCARFSYGNSRYWGQGTTLTVSSDQPVPSTPPTP
SPSTPPTPSPSCAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMEALHNHYTQKSL
SLSPGK 97. L6 scFv VHL11S (SSS-S)H WCH2 WCH3 (SEQ ID NO: 415)
Nucleotide sequence:
aagcttgttgttatggattttcaagtgcagattttcagcttcctgctaatcagtgcttcagtcataatgtccagaggacaaattgttctctcc
cagtctccagcaatcctgtctgcatctccaggggagaaggtcacattgacttgcagggccagctcaagtgtaagtttcatgaactgg
taccagcagaagccaggatcctcccccaaaccctggatttatgccacatccaatttggcttctgagttcctggtcgcttcagtggcg
agtggtctgggacctcttactctctcgcaatcagcagagtggtggctgaagatgctgccacttattactgccagcagtggaatagta
acccactcacgttcggtgctgggaccaagctggagctgaaagagctctctggtggcggtggctcgggcggtggtgggtcgggtg
gcggcggatctctgcagatccagttggtgcagtctggacctgagtcgaagaagcctggagagacagtcaagatctcctgcaaggc
ttctgggtataccttcacaaactatggaatgaactgggtgaagcaggctccaggaaagggtttaaagtggatgggctggataaaaca
cctacactggacagccaacatatgctgatgacttcaagggacggtttgccttctctttggaaacctctgcctacactgcctatttgcag -continued

```
atcaacaacctcaaaaatgaggacatggctacatatttctgtgcaagatttagctatggtaactcacgttacgctgactactggggcc
aaggcaccactctcacagtctcctctgatcaggagcccaaatcttctgacaaaactcacacatccccaccgtcctcagcacctgaac
tcctggggggaccgtcagtcttcctcttccccccaaaacccaaggacaccctcatgatctcccggacccctgaggtcacatgcgtg
gtggtggacgtgagccacgaagaccctgaggtcaagttcaactggtacgtggacggcgtggaggtgcataatgccaagacaaag
ccgcgggaggagcagtacaacagcacgtaccgtgtggtcagcgtcctcaccgtcctgcaccaggactggctgaatggcaagga
gtacaagtgcaaggtctccaacaaagcccccagccccatcgagaaaacaatcctccaaagccaaagggcagccccgagaac
cacaggtgtacaccctgcccccatcccgggatgagctgaccaagaaccaggtcagcctgacctgcctggtcaaaggcttctatcc
cagcgacatcgccgtggagtgggagagcaatgggcagccggagaacaactacaagaccacgcctcccgtgctggactccgac
ggctccttcttcctctacagcaagctcaccgtggacaagagcaggtggcagcaggggaacgtcttctcatgctccgtgatgcatga
ggctctgcacaaccactacacgcagaagagcctctccctgtctccgggtaaatgatctaga
```

Amino acid sequence (SEQ ID NO: 416):
MDFQVQIFSFLLISASVIMSRGQIVLSQSPAILSASPGEKVTLTCRASSSVSFMNYQ
QKPGSSPKPWIYATSNLASEFPGRFSGEWSGTSYSLAISRVEAEDAATYYCQQWNS
NPLTFGAGTKLELKELSGGGGSGGGGSGGGGSLQIQLVQSGPESKKPGETVKISCK
ASGYTFTNYGMNWVKQAPGKGLKWMGWINTYTGQPTYADDFKGRFAFSLETSA
YTAYLQINNLKNEDMATFCARFSYGNSRYADYWGQGTTLTVSSDQEPKSSDKT
HTSPPSSAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGK 98. P238 CH2 WCH3
a. P238S CH2 WCH3 (SEQ ID NO: 417)
Nucleotide sequence:
```
cctgaactcctgggggatcgtcagtcttcctcttcccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcgggaggagcagtacaacagcacgtaccgtgtggtcagcacgtcaccgtcctgcaccaggactggctgaatg
gcaaggagtacaagtgcaaggtctccaacaaagcccccagccccatcgagaaaacaatctccaaagccaaagggcagccc
cgagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccacgcctcccgtgctgg
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggaaatgatctaga
```

Amino acid sequence (SEQ ID NO: 418):
PELLGGSSVFLFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAKG
QPREPQVYTLPPSRDELTKNQVSLTCLVKGFYPSDIAVEWESNGQPENNYKTTPPV
LDSDGSFFLYSKLTVDKSRWQQGNVFSCSVMHEALHNHYTQKSLSLSPGK b. (SSS-S)H P238S CH2 WCH3 (SEQ ID NO: 419)
Nucleotide sequence:
```
tgatcaggagcccaaatcttctgacaaaactcacacatccccaccgtcctcagcacctgaactcctgggggatcgtcagtcttcct
cttccccccaaaacccaaggacaccctcatgatctcccggacccctgaggtcacatgcgtggtggtggacgtgagccacgaaga
ccctgaggtcaagttcaactggtacgtggacggcgtggaggtgcataatgccaagacaaagccgcgggaggagcagtacaaca
gcacgtaccgtgtggtcagcgtcctcaccgtcctgcaccaggactggctgaatggcaaggagtacaagtgcaaggtctccaacaa
agccctcccagcccccatcgagaaaacaatctccaaagccaaagggcagccccgagaaccacaggtgtacaccctgcccccat
cccgggatgagctgaccaagaaccaggtcagcctgacctgcctggtcaaaggcttctatcccagcgacatcgccgtggagtggg
agagcaatgggcagccggagaacaactacaagaccacgcctcccgtgctggactccgacggctccttcttcctctacagcaagct
caccgtggacaagagcaggtggcagcaggggaacgtcttctcatgctccgtgatgcatgaggctctgcacaaccactacacgca
gaagagcctctccctgtctccgggtaaatgatctaga
```

Amino acid sequence (SEQ ID NO: 420):
DQEPKSSDKTHTSPPSSAPELLGGSSVFLFPPKPKDTLMISRTPEVTCVVVDVSHED
PENVKFNWYVDGVEVHNAKTKPREEQYNSTYRVVSVLTVLHQDWLNGKEYKCKV
SNKALPAPIEKTISKAKGQPREPQVYTLPPSRDELTKNQVSLTCLVKGFYPSDIAVE
WESNGQPENNYKTTPPVLDSDGSFFLYSKLTVDKSRWQQGNVFSCSVMHEALHN
HYTQKSLSLSPGK*

99. a.CD16-6 low (ED) + NL + (SSS-S)H P238S CH2 WCH3 (SEQ ID NO: 421)
Nucleotide sequence:
```
ggagcccaaatcttctgacaaaactcacacatccccaccgtcctcagcacctgaactcctgggggtcgtcagtcttcctcttccc
cccaaaacccaaggacaccctcatgatctcccggacccctgaggtcacatgcgtggtggtggacgtgagccacgaagaccctga
ggtcaagttcaactggtacgtggacgcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagcccccatcgagaaaacaatctccaaagccaaagggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaatgatctaga
```

Amino acid sequence (SEQ ID NO: 422):
MWQLLLPTALLLLVSAGMRTEDLPKAVVFLEPQWYRVLEDSVTLKCQGAYSPE
DNSTQWFHNESLISSQASSYFIDAATVDDSGEYRCQTNLSTLSDPVQLEVHIGWLL
LQAPRWVFKEEDPIHLRCHSWKNTALHKVTYLQNGKGRKYFHHNSDFYIPKATL
KDSGSYFCRGLVGSKNVSSETVNITITQGLADQEPKSSDKTHTSPPSSAPELLGGSS
VFLFPPKPKDTLMISRTPEVTCVVVDVSHEDPEVKFNWYVDGVEVHNAKTKPREE -continued
QYNSTYRVVSVLTVLHQDWLNGKEYKCKVSNKALPAPKIEKTISKAKGQPREPQVY
TLPPSRDELTKNQVSLTCLVKGFYPSDIAVEWESNGQPENNYKTTPPVLDSDGSFF
LYSKLTVDKSRWQQGNVFSCSSVMEALHNHYTQKSLSLSGK 100. b.CD16-6 low (ED) + HE4LP + (SSS-S)H P238S CH2 WCH3 (SEQ ID NO: 423)
Nucleotide sequence:
aagcttgccgccatgcctgcttgtcgcctaggcccgctagccgccgcccctcctcctcagcctgctgctgttcggcttcaccctagtct
caggcaccggtgcaatgcggactgaagatctcccaaaggctgtggtgttcctggagcctcaatggtacagggtgctcgagaagg
acagtgtgactctgaagtgccagggagcctactcccctgaggacaattccacacagtggtttcacaatgagagcctcatctcaagc
caggcctcgagctacttcattgacgctgccacagtcgacgacagtggagagtacaggtgccagacaaacctctccaccctcagttg
acccggtgcagctagaagtccatatcggctggctgttgctccaggcccctcggtgggtgttcaaggaggaagaccctattcacctg
aggtgtcacagctggaagaacactgctctgcataaggtcacatatttacagaatggcaaaggcaggaagtattttcatcataattctg
acttctacattccaaaagccacactcaaagacagcggctcctacttctgcaggggcttgttgggagtaaaaatgtgtcttcagaga
ctgtgaacatcaccatcactcaaggtttggctgatcaggagcccaaatcttctgacaaaactcacacatccccaccgtcctcagcac
ctgaactcctgggggatcgtcagtcttcctcttccccccaaaacccaaggacaccctcatgatctcccggacccctgaggtcacat
gcgtggtggtggacgtgagccacgaagaccctgaggtcaagttcaactggtacgtggacggcgtggaggtgcataatgccaaga
caaagccgcgggaggagcagtacaacagcacgtaccgtgtggtcagcgtcctcaccgtcctgcaccaggactggctgaatggc
aaggagtacaagtgcaaggtctccaacaaagcctcccagccccatcgagaaaacaatctccaaagccaaagggcagccccg
agaaccacaggtgtacaccctgcccccatcccgggatgagctgaccaagaaccaggtcagcctgacctgcctggtcaaaggctt
ctatcccagcgacatcgccgtggagtgggaggagcaatgggcagccggagaacaactacaagaccacgcctcccgtgctggact
ccgacggctccttcttcctctacagcaagctcaccgtggacaagagcaggtggcagcaggggaacgtcttctcatgctccgtgatg
catgaggctctgcacaaccactacacgcagaagagcctctccctgtctccgggtaaatgatctagaaa Amino acid sequence (SEQ ID NO: 424):
MPACRLGPLAAALLLSLLLFGFTLVSGTGAMRTEDLPKAVVFLEPQWYRVLEKDS
VTLKCQGAYSPEDNSTQWFHNESLISSQASSYFIDAATVDDSGEYRCQTNLSTLSD
PVQLEVHIGWLLLQAPRWVFKEEDPIHLRCHSWKNTALHKVTYLQNGKGRKYFH
HNSDFYIPKATLKDSGSYFCRGLVGSKNVSSETVNITITQGLADQEPKSSDKTHTSP
PSSAPELLGGSSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKT
TPPVLDSDGSFFYLSKLTVDKSRWQQGNVFSCSVMHEALHNHYTQKSLSLSPGK 101. CD16-9 high (ED) (SSS-S)H P238S CH2 CH3
a. CD16-9 high (ED)NL + (SSS-S)H P238S CH2 CH3 (SEQ ID NO: 425)
Nucleotide sequence:
gttgttaagcttgccgccatgtggcagctgctcctcccaactgctctgctacttctagtttcagctggcatgcggactgaagatctccc
aaaggctgtggtgttcctggagcctcaatggtacagggtgctcgagaaggacagtgtgactctgaagtgccagggagcctactcc
cctgaggacaattccacacagtggtttcacaatgagagcctcatctcaagccaggcctcgagctacttcattgacgctgccacagtc
gacgacagtggagagtacaggtgccagacaaacctctccaccctcagtgacccggtgcagctagaagtccatatcggctggctgt
tgctccaggcccctcggtgggtgttcaaggaggaagaccctattcacctgaggtgtcacagctggaagaacactgctctgcataag
gtcacatatttacagaatggcaaaggcaggagtattttcatcataatctgacttctacattccaaaagccacactcaaagacagcg
gctcctacttctgcaggggctttgggagtaaaaatgtgtcttcagagactgtgaacatcaccatcactcaaggtttggctgatcag
gagcccaaatcttctgacaaaactcacacatccccaccgtcctcagcacctgaactcctgggggatcgtcagtcttcctcttcccc
ccaaaacccaaggacaccctcatgatctcccggacccctgaggtcacatgcgtggtggtggacgtgagccacgaagaccctgag
gtcaagttcaactggtacgtggacggcgtggaggtgcataatgccaagacaaagccgcgggaggagcagtacaacagcacgta
ccgtgtggtcagcgtcctcaccgtcctgcaccaggactggctgaatggcaaggagtacaagtgcaaggtctccaacaaagccctc
ccagccccatcgagaaaacaatctccaaagccaaagggcagccccgagaaccacaggtgtacaccctgcccccatcccggga
tgagctgaccaagaaccaggtcagcctgacctgcctggtcaaaggcttctatcccagcgacatcgccgtggagtgggagagcaat
gggcagccggagaacaactacaagaccacgcctcccgtgctggactccgacggctccttcttcctctacagcaagctcaccgtgg
acaagagcaggtggcagcaggggaacgtcttctcatgctccgtgatgcatgaggctctgcacaaccactacacgcagaagagcc
tctccctgtctccgggtaaatgatctagaaa Amino acid sequence (SEQ ID NO: 426):
MWQLLLPTALLLLVSAGMRTEDLPKAVVFLEPQWYRVLEKDSVTLKCQGAYSPE
DNSTQWFHNESLISSQASSYFIDAATVDDSGEYRCQTNLSTLSDPVQLEVHIGWLL
LQAPRWVFKEEDPIHLRCHSWKNTALHKVTYLQNGKGRKYFHHNSDFYIPKATL
KDSGSYFCRGLFGSKNVSSETVNITITQGLADQEPKSSDKTHTSPPSSAPELLGGSS
VFLFPPKPKDTLMISRTPEVTCVVVDVSHEDPEVKFNWYVDGVEVHNAKTKPREE
QYNSTYRVVSVLTVLHQDWLNGKEYKCKVSNKALPAPIEKTISKAKGQPREPQVY
TLPPSRDELTKNQVSLTCLVKGFYPSDIAVESNGQPENNYKTTPPVLDSDGSFF
LYSKLTVDKSRWQQGNVFSCSVMHEALHNHYTQKSLSLSPGK CD16-9 high (ED) + HE4LP + hIgG1 (SSS-S)H P238S CH2 CH3 (SEQ ID NO: 427)
Nucleotide sequence:
aagcttgccgccatgcctgcttgtcgcctaggcccgctagccgccgcccctcctcctcagcctgctgctgttcggcttcaccctagtct
caggcaccggtgcaatgcggactgaagatctcccaaaggctgtggtgttcctggagcctcaatggtacagggtgctcgagaagg
acagtgtgactctgaagtgccagggagcctactcccctgaggacaattccacacagtggtttcacaatgagagcctcatctcaagc
caggcctcgagctacttcattgacgctgccacagtcgacgacagtggagagtacaggtgccagacaaacctctccaccctcagttg
acccggtgcagctagaagtccatatcggctggctgttgctccaggcccctcggtgggtgttcaaggaggaagaccctattcacctg
aggtgtcacagctggaagaacactgctctgcataaggtcacatatttacagaatggcaaaggcaggaagtattttcatcataattctg
acttctacattccaaaagccacactcaaagacagcggctcctacttctgcaggggcttttgggagtaaaaatgtgtcttcagagac
tgtgaacatcaccatcactcaaggtttggctgatcaggagcccaaatcttctgacaaaactcacacatccccaccgtcctcagcacct
gaactcctgggggatcgtcagtcttcctcttccccccaaaacccaaggacaccctcatgatctcccggacccctgaggtcacatg
cgtggtggtggacgtgagccacgaagaccctgaggtcaagttcaactggtacgtggacggcgtggaggtgcataatgccaagac
aaagccgcgggaggagcagtacaacagcacgtaccgtgtggtcagcgtcctcaccgtcctgcaccaggactggctgaatggca
aggagtacaagtgcaaggtctccaacaaagccctcccagccccatcgagaaaacaatctccaaagccaaagggcagccccga
gaaccacaggtgtacaccctgcccccatcccgggatgagctgaccaagaaccaggtcagcctgacctgcctggtcaaaggcttct
atcccagcgacatcgccgtggaagtgggagagcaatgggcagccggagaacaactacaagaccacgcctcccgtgctggactcc -continued gacggctccttcttcctctacagcaagctcaccgtggacaagagcaggtggcagcaggggaacgtcttctcatgctccgtgatgca
tgaggctctgcacaaccactacacgcagaagagcctctccctgtctccgggtaaatgatctagaaa Amino acid sequence (SEQ ID NO: 428):
MPACRLGPLAAALLLSLLLFGFTLVSGTGAMRTEDLPKAVVFLEPQWYRVLEKDS
VTLKCQGAYSPEDNSTQWFHNESLISSQASSYFIDAATVDDSGEYRCQTNLSTLSD
PVQLEVHIGWLLLQAPRWVFKEEDPIHLRCHSWKNTALHKVTYLQNGKGRKYFH
HNSDFYIPKATLKDSGSYFCRGLFGSKNVSSETVNITITQGLADQEPKSSDKTHTSP
PSSAPELLGGSSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKT
TPPVLDSDGSFFLYSKLTVDKSRWQQGNVFSCSVMHEALHNHYTQKSLSLSPGK 102. a. CD16 ED low (native leader) (SEQ ID NO: 429)
Nucleotide sequence:
aagcttgccgccatgtggcagctgctcctcccaactgctctgctacttctagtttcagctggcatgcggactgaagatctcccaaagg
ctgtggtgttcctggagcctcaatggtacagggtgctcgagaaggacagtgtgactctgaagtgccaggagcctactccctgag
gacaattccacacagtggtttcacaatgagagcctcatctcaagccaggcctcgagctacttcattgacgctgccacagtcgacgac
agtggagagtacaggtgccagacaaacctctccaccctcagtgaccccggtgcagctagaagtccatatcggctggctgttgctcca
ggcccctcggtgggtgttcaaggaggaagaccctattcacctgaggcacagctggaagaacactgctctgcataaggtcacat
atttacagaatggcaaaggcaggaagtatttcatcataattctgacttctacattccaaaagccacactcaaagacagacggctcctac
ttctgcaggggcttgttgggagtaaaaatgtgtcttcagagactgtgaacatcaccatcactcaaggtttggctgatcaaaa Amino acid sequence (SEQ ID NO: 430):
mwqlllptallllvsagmrtedlpkavvflepqwyrvlekdsvtlkcqgayspednstqwfhneslissqassyfidaatvdds
geyrcqtnlstlsdpvqlevhigwlllqaprwvfkeedpihlrchswkntalhkvtylqngkggrkyfhhnsdfyipkatlkdsg
syfcrglvgsknvssetvnititqgladq b. CD16 ED low (HE4 leader) (SEQ ID NO: 431)
Nucleotide sequence
aagcttgccgccatgcttgtcgcctaggcccgctagccgccgccctcctcctcagcctgctgctgttcggcttcaccctagtct
caggcaccggtgcaatgcggactgaagatctcccaaaggctgtggtgttcctggagcctcaatggtacagggtgctcgagaagg
acagtgtgactctgaagtgccaggagcctactccctgaggacaattccacacagtggtttcacaatgagagcctcatctcaagc
caggcctcgagctacttcattgacgctgccacagtcgacgacagtggagagtacaggtgccagacaaacctctccaccctcagtg
acccggtgcagctagaagtccatatcggctggctgttgctccaggcccctcggtgggtgttcaaggaggaagaccctattcacctg
aggtgtcacagctggaagaacactgctctgcataaggtcacatatttacagaatggcaaaggcaggaagtatttcatcataattctg
acttctacattccaaaagccacactcaaagacagcggctcctacttctgcaggggcttgttgggagtaaaaatgtgtcttcagaga
ctgtgaacatcaccatcactcaaggtttggctgatcaaa Amino acid sequence (SEQ ID NO: 432)
mpacrlgplaaallslllfgftlvsgtgamrtedpkavvflepqwyrvelekdsvtlkcqgayspednstqwfhneslissqass
yfidaatvddsgeyrcqtnlstlsdpvqlevhigwlllqaprwvfkeedpihlrchswkntalhkvtylqngkgrkyfhhnsdf
yipkatlkdsgsyfcrglvgsknvssetvnititqgladq 103. a. CD16 ED high (native leader) (SEQ ID NO: 433)
Nucleotide sequence:
gttgttaagcttgccgccatgtggcagctgctcctcccaactgctctgctacttctagtttcagctggcatgcggactgaagatctccc
aaaggctgtggtgttcctggagcctcaatggtacagggtgctcgagaaggacaggactctgaagtgccaggagcctactcc
cctgaggacaattccacacagtggtttcacaatgagagcctcatctcaagccaggcctcgagctacttcattgacgctgccacagtc
gacgacagtggagagtacaggtgccagacaaacctctccaccctcagtgacccggtgcagctagaagtccatatcggctggctgt
tgctccaggcccctcggtgggtgttcaaggaggaagaccctattcacctgaggtgtcacagctggaagaacactgctctgcataag
gtcacatatttacagaatggcaaaggcaggaagtatttcatcataattctgacttctacattccaaaagccacactcaaagacagcg
gctcctacttctgcaggggcttttgggagtaaaaatgtgtcttcagagactgtgaacatcaccatcactcaaggtttggctgatcaa
a Amino acid sequence (SEQ ID NO: 434):
mwqlllptallllvsgmrtedlpkavvflepqwyrvlekdsvtlkcqgayspednstqwfhneslissqassyfidaatvdds
geyrcqtnlstlsdpvqlevhigwlllqaprwvfkeedpihlrchswkntalhkvtylqngkgrkyfhhnsdfyipkatlkdsg
syfcrglfgsknvssetvnititqgladq b. CD16 ED high (HE4 leader) (SEQ ID NO: 435)
Nucleotide sequence:
aagcttgccgccatgcttgcttgtcgcctaggcccgctagccgccgccctcctcctcagcctgctgctgttcggcttcaccctagtct
caggcaccggtgcaatgcggactgaagatctcccaaaggctgtggtgttcctggagcctcaatggtacagggtgctcgagaagg
acagtgtgactctgaagtgccaggagcctactccctgaggacaattccacacagtggtttcacaatgagagcctcatctcaagc
caggcctcgagctacttcattgacgctgccacagtcgacgacagtggagagtacaggtgccagacaaacctctccaccctcagtg
acccggtgcagctagaagtccatatcggctggctgttgctccaggcccctcggtgggtgttcaaggaggaagaccctattcacctg
aggtgtcacagctggaagaacactgctctgcataaggtcacatatttacagaatggcaaaggcaggaagtatttcatcataattctg
acttctacattccaaaagccacactcaaagacagcggctcctacttctgcaggggcttttgggagtaaaaatgtgtctcagagac
tgtgaacatcaccatcactcaaggtttggctgatcaaa Amino acid sequence (SEQ ID NO: 436):
MPACRLGPLAAALLLSLLLFGFTLVSGTGAMRTEDLPKAVVFLEPQWYRVLEKDS
VTLKCQGAYSPEDNSTQWFHNESLISSQASSYFIDAATVDDSGEYRCQTNLSTLSD
PVQLEVHIGWLLLQAPRWVFKEEDPIHLRCHSWKNTALHKVTYLQNGKGRKYFH
HNSDFYIPKATLKDSGSYFCRGLFGSKNVSSETVNITITQGLADQ 104. 2e12 scFv (SSS-S)H P238S CH2 WCH3-hCD80TM/CT (SEQ ID NO: 437)
Nucleotide sequence:
aagcttatggattttcaagtgcagattttcagcttcctgctaatcagtgcttcagtcataatgtccagaggagtcgacattgtgctcaccc
aatctccagcttctttggctgtgtctcataggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcgggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctggagtggctgggaatgat
atgggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacacatccccaccgtcccca
gcacctgaactcctggggggatcgtcagtcttcctcttcccccaaaacccaaggacaccctcatgatctcccggacccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagcccccccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaagcggatccttcgaacctgctccc
atcctgggccattaccttaatctcagtaaatggaattttttgtgatatgctgcctgacctactgctttgccccaagatgcagagagagaa
ggaggaatgagagattgagaagggaaagtgtacgccctgtataaatcgat Amino acid sequence (SEQ ID NO: 438):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKFN
WYVDGVEHNVRNAKTKPREEQYNSTYRVVSVLTVLHQDWLNGKEYKCKVSNTKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNLLPSWAITLISVNGIFVICCLTYCFAPRCRERRRNERLRRESVRPV 105. 10A8 scFv (SSS-S)H P238SCH2 WCH3-hCD80TM/CT (SEQ ID NO: 439)
Nucleotide sequence:
aagcttatggattttcaagtgcagattttcagcttcctgctaatcagtgcttcagtcataatgtccagaggagtcgacatccagatgaca
cagtctccatcctcactgtctgcatctctgggaggcaaagtcaccatcacttgcaaggcaagccaagacattaagaagtatataggtt
ggtaccaacacaagcctggaaaaggtcccaggctgctcatatattacacatctacattacagccaggcatcccatcaaggttcagg
gaagtgggtctgggagagattattccctcagcatcagaaacctggagcctgaagatattgcaacttattattgtcaacagtatgataat
cttccattgacgttcggctcggggacaaagttggaaataaaacgggtggcggtggctcgggcggtggtggctcgggtggcggc
ggatctgatgtacagcttcaggagtcaggacctggcctcgtgaaaccttctcagtctctgtctctcacctgctctgtcactggctactc
catcaccagtggtttctactggaactggatccgacagtttccgggaaacaaactggaatggatgggccacataagccacgacggta
ggaataactacaaccatctctcataaatcgaatctccatcactcgtgacacatctaagaaccagttttttcctgaagttgagttctgtga
ctactgaggacacagctacatatttctgtgcaagacactacgtgagtagcggagcctatgactwcggccaagggaccacagtc
accgtctcctctgatctggagcccaaatcttctgacaaaactcacacatccccaccgtccccagcacctgaactcctggggggatc
gtcagtcttcctcttccccccaaaacccaaggacaccctcatgatctcccggacccctgaggtcacatgcgtggtggtggacgtga
gccacgaagaccctgaggtcaagttcaactggtacgtggacggcgtggaggtgcataatgccaagacaaagccgcgggagga
gcagtacaacagcacgtaccgtgtggtcagcgtcctcaccgtcctgcaccaggactggctgaatggcaaggagtacaagtgcaa
ggtctccaacaaagcccccagccccatcgagaaaaccatctccaaagccaaagggcagccccgagaaccacaggtgtaca
ccctgcccccatcccgggatgagctgaccaagaaccaggtcagcctgacctgcctggtcaaaggcttctatcccagcgacatcgc
cgtggagtgggagagcaatgggcagccggagaacaactacaagaccacgcctcccgtgctggactccgacggctccttcttcct
ctacagcaagctcaccgtggacaagagcaggtggcagcaggggaacgtcttctcatgctccgtgatgcatgaggctctgcacaac
cactacacgcagaagagcctctccctgtctccgggtaaagcggatccttcgaacctgctcccatcctgggccattaccttaatctca
gtaaatggaattttttgtgatatgctgcctgacctactgctttgccccaagatgcagagagagaaggaggaatgagagattgagaagg
gaaagtgtacgccctgtataaatcgat Amino acid sequence (SEQ ID NO: 440):
MDFQVQIFSFLLISASVIMSRGVDIQMTQSPSSLSASLGGKVTITCKASQDIKKYIG
WYQHKPGKGPRLLLYYTSTLQPGIPSRFSGSGSGRDYSLSLIRNLEPDIATYYCQQY
DNLPLTFGSGTKLEIKRGGGGSGGGGSGGGGSDVQLQESGPGLVKPSQSLSLTCSV
TGYSITSGFYWNWIRQFPGNKLEWMGHISHDGRNNYNPSLINRISITRDTSKNQFFL
KLSSVTTEDTATYFCARHYGSSGAMDYWGQGTSVTVSSDLEPKSSDKTHTSPPSP
APELLGGSSVFLFPPKPKDTLMISRTPEVTCVVVDVSHEDPEVKFNWYVDGVEVH
NAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGKADPS
NLLPSWAITLISVNGIFVICCLTYGFAPRCRERRRNERLRRESVRPV 106. 2H7 scFv VHL11S (SSS-P)H P238SCH2CH3-hCD80TM/CT (SEQ ID NO: 441)
Nucleotide sequence:
aagcttgccgcatggattttcaagtgcagattttcagcttcctgctaatcagtgcttcagtcataattgccagaggacaaattgttctct
cccagtctccagcaatcctgtctgcatctccaggggagaaggtcacaatgacttgcagggccagctcaagtgtaagttacatgcact
ggtaccagcagaagccaggatcctcccccaaaccctggatttatgcccccatccaactctggagttctgggtctcctgctcagtg
gcagtgggtctgggacctcttactctctcacaatcagcagagtggaggctgaagatgctgccacttattactgccagcagtggagttt
taacccacccacgttcggtgctgggaccaagctggagctgaaagatggcggtggctcgggcggtggtggatctgaggaggtg
ggagctctcaggcttatctacagcagtctggggctgagtcggtgaggcctggggcctcagtgaagatgtcctgcaaggcttctggc
tacacatttaccagttacaatatgcactgggtaaagcagacacctagacagggcctggaattggattggagctatttatccaggaaat -continued ggtgatacttcctacaatcagaagttcaagggcaaggccacactgtctagacaaatcctccagcacagcctacatgcagctcag
cagcctgacatctgaagactctgcggtctatttctgtgcaagagtggtgtactatagtaactcttactggtacttcgatgtctggggcac
agggaccacggtcaccgtctcttctgatctggagcccaaatcttctgacaaaactcacacatccccaccgtcccagcacctgaact
cctgggggatcgtcagtcttcctcttccccccaaaacccaaggacaccctcatgatctcccggacccctgaggtcacatgcgtgg
tggtggacgtgagccacgaagaccctgaggtcaagttcaactggtacgtggacggcgtggaggtgcataatgccaagacaaagc
cgcgggaggagcagtacaacagcacgtaccgtgtggtcagcgtcctcaccgtcctgcaccaggactggctgaatggcaaggag
tacaagtgcaaggtctccaacaaagcctcccagcccccatcgagaaaaccatctccaaagccaaagggcagccccgagaacc
acaggtgtacaccctgcccccatcccgggatgagctgaccaagaaccaggtcagcctgacctgcctggtcaaaggcttctatccc
agcgacatcgccgtggagtgggagagcaatgggcagccggagaacaactacaagaccacgcctcccgtgctggactccgacg
gctccttcttcctctacagcaagctcaccgtggacaagagcaggtggcagcaggggaacgtcttctcatgctccgtgatgcatgag
gctctgcacaaccactacacgcagaagagcctctccctgtctccgggtaaagcggatcctcgaacctgctcccatcctgggccatt
accttaatctcagtaaatgaattttgtgatatgctgcctgacctactgctttgccccaagatgcagagagagaaggaggaatgaga
gattgagaagggaaagtgtacgccctgtataaatcgat Amino acid sequence (SEQ ID NO: 442):
MDFQVQSFLLISASVIIARGQIVLSQSPAILSASPGEKVTMTCRASSSVSYMHWY
QQKPGSSPKPWIYAPSNLASGVPARFSGSGSGTSYSLTISRVEAEDAATYYCQQWS
FNPPTFGAGTKLELKDGGGSGGGGSGGGGSSQAYLQQSGAESVRPGASVKMSCK
ASGYTFTSYNMHWVKQTPRQGLEWIGAIYPGNGDTSYNQKFKGKATLTVDKSSS
TAYMQLSSLTSEDSAVYFCARVVYYSNSYWYFDVWGTGTTVTVSSDLEPKSSDK
THTSPPSPAPELLGGSSVFLFPPKPKDTLMISRTPEVTCVVVDVSHEDPEVKFNWYV
DGVEVNAKTKPREEQYNSTYRVVSVLTVLHQDWLNGKEYKCKVSNKALPAPIE
KTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLS
PGKADPSNLLPSWAITLISVNGIFVICCLTYCFAPRCRERRRNERLRRESVRPV 107. G19-4 scFv (SSS-P)H P238SCH2 WCH3-hCD80TM/CT (SEQ ID NO: 443)
Nucleotide sequence:
aagcttatggattttcaagtgcagattttcagcttcctgctaatcagtgcttcagtcataatgtccagaggagtcgacatccagatgaca
cagactacatcctccctgtctgcctctctgggagacagagtcaccatcagttgcagggcaagtcaggacattcgcaattatttaaact
ggtatcagcagaaaccagatggaactgtaaactcctgatctactacacatcaagatacactcaggagtcccatcaaggttcagtg
gcagtgggtctggaacagattattctctcaccattgccaacctgcaaccagaagatattgccacttacttttgccaacagggtaatac
gcttccgtggacgttcggtggaggcaccaaactggtaaccaaacgggagctcggtggcggtggctcgggcggtggtgggtcgg
gtggcggcggatctcatggaggtccagctgcaacagtctggacctgaagcagagccatggaaagaacctgagtggattggacttattaatccat
acaaaggtcttactacctacaaccagaaattcaagggcaaggccacattaactgtagacaagtcatccagcacagcctacatggag
ctcctcagtctgacatctgaagactctgcagtctattactgtgcaagatctgggtactatggtgactcggactggtacttcgatgtctgg
ggcgcagggaccacggtcaccgtctcctctgatctggagcccaaatcttctgacaaaactcacacaagcccaccgagcccagca
cctgaactcctgggggatcgtcagtcttcctcttccccccaaaacccaaggacaccctcatgatctcccggacccctgaggtcac
atgcgtggtggtggacgtgagccacgaagaccctgaggtcaagttcaactggtacgtggacggcgtggaggtgcataatgccaa
gacaaagccgcgggaggagcagtacaacagcacgtaccgtgtggtcagcgtcctcaccgtcctgcaccaggactggctgaatg
gcaaggagtacaagtgcaaggtctccaacaaagcctcccagcccccatcgagaaaaccatctccaaagccaaagggcagccc
cgagaaccacaggtgtacaccctgcccccatcccgggatgagctgaccaagaaccaggtcagcctgacctgcctggtcaaagg
cttctatcccagcgacatcgccgtggagtgggagagcaatgggcagccggagaacaactacaagaccacgcctcccgtgctgg
actccgacggctccttcttcctctacagcaagctcaccgtggacaagagcaggtggcagcaggggaacgtcttctcatgctccgtg
atgcatgaggctctgcacaaccactacacgcagaagagcctctccctgtctccgggtaaagcggatcctcgaacctgctcccatc
ctgggccattaccttaatctcagtaaatgaattttgtgatatgctgcctgacctactgctttgccccaagatgcagagagagaagga
ggaatgagagattgagaagggaaagtgtacgccctgtataaatcgatactcgag Amino acid sequence (SEQ ID NO: 444):
MDFQVQIFSFLLISASVIMSRGVDIQMTQTTSSLSASLGDRVTISCRASQDIRNYN
WYQQKPDGTVKLLIYYTSRLHSGVPSRFSGSGSGTDYSLTIANLQPEDIATYFCQQ
GNTLPWTFGGGTKLVTKRELGGGGSGGGGSGGGGSIDEVQLQQSGPELVKPGAS
MSCKASGYSFTGYIVNWLKQSHGKNLEWIGLINPYKGLTTYNQKFKGKATLTVD
KSSSTAYMELLSLTSEDSAVYYCARSGYYGDSDWYFDVWGAGTTVTVSSDLEPK
SSDKTHTSPPSPAPELLGGSSCFLFPPKPKDTLMISRTPEVTCVVVDVSHEDPEVKF
NWYVDGVEVHNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQ
KSLSLSPGKADPSNLLPSWAITLISVNGIFVICCLTYCFAPRCRERRRNERLRRESVR
PV 108. 2e12 scFv IgA WH WCH2 T4 CH3-hCD80TM/CT (SEQ ID NO: 445)
Nucleotide sequence:
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacctagaatctggggtccctgcc
aggttagtggcagtgggtctgggacagacttcagcctcaacatccatcctgtggaggaggatgatattgcaatgtattttctgtcagc
aaagtaggaaggttccttggacgttcggtggaggcaccaagctggaaatcaaacgggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctattggtgtaaactgggttcgccagcctccaggaaagggtctggagtggctgggaatgat
atggggtgatggaagcacagactattaattcagctctcaaatccagactggacaaagtaagagcaacaaccaaggttttctt
aaaaatgaacagtctgcaaactgatgacacagccagatactactgtgccagagatggttatagtaactttcattactatgttatggact
actggggtcaaggaacctcagtcaccgtctcctcagatcagccagttccctcaactccacctaccccatctccctcaactccaccta
cccctctccccatgctgccacccccgactgtcactgcaccgaccggccctcgaggacctgctcttaggttcagaagcgatcctc
acgtgcacactgacccgcctgagagatgcctcaggtgtccacctcttcctggacgccctcaagtgggacagcaactcgttcaaggac
cacctgacccgtgacctctgtgctgctacagcatgtgccagtgtcctgccgggctgtgccgagccatggaaccatgggaagacctt
cacttgcactgctgcctaccccgagtccaagacccccgctaaccgccaccctctcaaaatccggaaacacattccggcccgaggtcc
acctgctgccgcgccgtcggaggagctggccctgaacgagctggtgacgctgacgctgacgtgcctggcacgtggcttcagcccccaag
gatgtgctggttcgctggctgcaggggtcacaggagctgccccgcgagaagtacctgacttgggcatcccggcaggagcccag -continued
ccagggcaccaccaccttcgctgtgaccagcatactgcgcgtggcgccgaggactggaagaaggggggacacaattctcctgcat
ggtgggccacgaggccctgccgctggccttcacacagaagaccatcgaccgcttggcgggtaaacccacccatgtcaatgtgtct
gttgtcatggcggaggtggacgcggatccttcgaacaacctgctcccatcctgggccattaccttaatctcagtaaatgaattttgt
gatatgctgcctgacctactgctttgccccaagatgcagagagagaaggaggaatgagagattgagaagggaaagtgtacgccct
gtataaatcgatac Amino acid sequence (SEQ ID NO: 446):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKNSLQTDDTARYYCARDGYSNFHYYVMDYWGQGTSVTVSSDQPVPS
TPPTPSPSTPPTPSPSCCHPRLSLHRPALEDLLLGSEAILTCLTLGLRDASGVTFTWTP
SSGKSAVQGPPDRDLCGCYSVSSVLPGCAEPWNHGKTFTCTAAYPESKTPLTATLS
KSGNTFRPEVHLLPPPSEELALNELVTLTCLARGFSPKDVLVRWLQGSQELPREKY
LTWASRQEPSQGTTTFAVTSILRVAAEDWKKGDTFSCMVGHEALPLAFTQKTIDR
LAGKPTHVNVSVVMAEVDADPSNNLLPSWAITLISVNGIFVICCLTYCFAPRCRER
RRNERLRRESVRPV 109. 2e12 scFV (SSS-P)H P238S CH2 WCH3-mFADD-TM/CT (SEQ ID NO: 447)
Nucleotide sequence:
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctgagtggctgggaatgat
atgggtgatggaagcacagactataattcagctctcaaatccagactgagcatcaccaaggacaactccaagagccaagttttctt
aaaaatgaacagtctgcaaactgatgacacagccagatactgtgccagagatggttatagtaactttcattactatgttatggact
actggggtcaaggaacctcagtcaccgtctcctcagatctggagcccaaatcttctgacaaaactcacacatccccaccgtcccca
gcacctgaactcctgggtggatcgtcagtcttcctcttcccccaaaacccaaggacaccctcatgatctcccggacccctgaggtc
acatgcgtggtggtggacgtgagccacgaagaccctgaggtcaagttcaactggtacgtggacggcgtggaggtgcataatgcc
aagacaaagccgcgggaggagcagtacaacagcacgtaccgtgtggtcagcgtcctcaccgtcctgcaccaggactggctgaa
tggcaaggagtacaagtgcaaggtctccaacaaagcctcccagcccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaagcggatccttcgaacaacgggaccat
tcctggtgctgctgcactcgctgtccggcagcctgtcggcaacgatctgatggagctcaagttcttgtgccgcgagcgcgtgagc
aaacgaaagctggagcgcgtgcagagtggcctggacctgttcacggtgctgctggagcagaacgacctggagcgcgggcaca
ccgggctgctgcgcgagttgctggcctcgctgcgccgacacgatctactgcagcgcctggacgacttcgaggcgggacggcg
accgctgcgccccggggaggcagatctgcaggtggcatttgacattgtgtgtgacaatgtggggagagactggaaaagactg
gcccgcgagctgaaggtgtctgaggccaagatggatgggattgaggagaagtaccccccgaagtctgagtgagcgggtaaggga
gagtctgaaagtctggaagaatgctgagaagaagaacgcctcggtggccggactggtcaaggcgctgcgggacctgcaggctga
atctggtggctgacctggtggaagaagcccaggaatctgtgagcaagagtgagaatatgtccccagtactaagggattcaactgtg
tcttcctcagaaacaccctgactcgagatcgat Amino acid sequence (SEQ ID NO: 448):
MDFQVQIFSFLLISASVIMSRGVDIVLTQSPASLAVSLGQRATICRASESVEYYVTS
LMQWYQQKPGQPPKLLISAASNVESGVPARFSGSGSGTDFSLNIHPVEEDDIAMYF
CQQSRKVPWTFGGGTKLEIKRGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMDPFLVLLHSLSGSLSGNDLMELKFLCRERVSKRKLERVQWSGLDL
FTVLLEQNDLERGHTGLLRELLASLRRHDLLQRLDDFEAGTATAAPPPGEADLQVA
FDIVCDNVGRDWKRLARELKVSEAKMDGIEEKYPRSLSERVRESLKVWKNAEKK
NASVAGLVKALRTCRLNLVADLVEEAQESVSKSENMSPVLRDSTVSSSETP 110. 2e12 scFv (SSS-P)H WCH2WCH3-mFADD-TM/CT (SEQ ID NO: 449)
Nucleotide sequence:
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctgagtggctgggaatgat
atgggtgatggaagcacagactataattcagctctcaaatccagactgagcatcaccaaggacaactccaagagccaagttttctt
aaaaatgaacagtctgcaaactgatgacacagccagatactacttgccagagatggttatagtaactttcattactatgttatggact
actggggtcaaggaacctcagtcaccgtctcctcagatctggagcccaaatcttctgacaaaactcacacatccccaccgtcccca
gcacctgaactcctgggtggatcgtcagtcttcctcttcccccaaaacccaaggacaccctcatgatctcccggacccctgaggt
cacatgcgtggtggtggacgtgagccacgaagaccctgaggtcaagttcaactggtacgtggacggcgtggaggtgcataatgcc
caagacaaagccgcgggaggagcagtacaacagcacgtaccgtggtcagcgtcctcaccgtcctgcaccaggactggctga
atggcaaggagtacaagtgcaaggtctccaacaaagcctcccagcccccatcgagaaaaccatctccaaagccaaagggcag
ccccgagaaccacaggtgtacaccctgcccccatcccgggatgagctgaccaagaaccaggtcagcctgacctgcctggtcaaa -continued ggcttctatcccagcgacatcgccgtggagtgggagagcaatgggcagcggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctcctgtctccgggtaaagcggatccttcgaacatggacc
cattcctggtgctgctgcactcgctgtccggcagcctgtcgggcaacgatctgatggagctcaagttcttgtgccgcgagcgcgtg
agcaaacgaaagctggagcgcgtgcagagtggcctggacctgttcacggtgctgttggagcagaacgacctggagcgcgggc
acaccgggctgctgcgcgagttgctggcctcgctgcgccgacacgatctactgcagcgcctggacgacttcgaggcggggacg
gcgaccgctgcgccccggggaggcagatctgcaggtggcatttgacattgtgtgtgacaatgtggggagagactggaaaga
ctggcccgcgagctgaaggtgtctgaggccaagatggatgggattgaggagaagtaccccccgaagtctgagtgagcgggtaag
ggagagtctgaaagtctggaagaatgctgagaagaagaacgcctcggtggccggactggtcaaggcgctgccggacctgcaggc
tgaatctggtggctgacctggtggaagaagcccaggaatctgtgagcaagagtgagaatatgtccccagtactaagggattcaact
gtgtcttcctcagaaacaccctgactcgagatcgat Amino acid sequence (SEQ ID NO: 450):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGPSVFLFPPKYKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKDPSNMDPFLVLLHSLSGSLSGNDLMELKYLCRERVSKLERVQSGLDL
FTVLLEQNDLERGHTGLLRELLASLRRHDLLQRLDDFEAGTATAAPPGEADLQVA
FDIVCDNVGRDWKRLARELKVSEAKMDGIEEKYPRSLSERVRESLKVWKNAEKK
NASVAGLVKALRTCRLNLVADLVIEEAQESVSKSENMSPVLRDSTVSSSETP 111. mcasp3-TM/CT (SEQ ID NO: 451)
Nucleotide sequence:
Ggatccttcgaacatggagaacaacaaaacctcagtggattcaaaatccattaataattttgaagtaaagaccatacatgggagcaa
gtcagtggactctgggatctatctggacagtagttacaaaatggattatcctgaaatgggcatatgcataataattaataataagaactt
ccataagagcactggaatgtcatctcgctctggtacggatgtggacgcagccaacctcagagagacattcatgggcctgaaatacc
aagtcaggaataaaaatgatcttactcgtgaagacattttggaattaatggatagtgtttctaaggaagatcatagcaaaaggagcag
ctttgtgtgtgattctaagccatggtgatgaagggtcattgatgggacaaatggggcctgttgaactgaaaaagttgactagcttctt
cagaggcgactactgccggagtctgactggaaagccgaaactcttcatcattcaggcctgccggggtacggagctggactgtgc
attgagacagacagtgggactgatgaggagatggcttgccagaagataccggtggaggctgacttcctgtatgcttactctacagc
acctggttactattcctggagaaattcaaaggacgggtcgtggttcatccagtccctttgcagcatgctgaagctgtacgcgcacaa
gctagaatttatgcacattctcactcgcgttaacaggaaggtggcaacggaattcgagtccttctccctggactccactttccacgca
aagaaacagatcccgtgtattgtgtccatgctcacgaaagaactgtacttttatcactagctcgagatcgatg Amino acid sequence (SEQ ID NO: 452):
DPSNMENNKTSVDSKSINNFEVKTIHGSKSVDSGIYLDSSYKMDYPEMGICIIINNK
NFHKSTGMSSRSGTDVDAANLRETFMGLKYQVRNKNDLTREDILELMDSVSKED
HSKRSSFVCVILSHGDEGVIYGTNGPVELKKLSFFRGDYCRSLTGKPKLFIIQACR
GTELDCGIETDSGTDEEMACQKIPVEADFLYAYSTAPGYYSWRNSKDGSWFIQSL
CSMLKLYAHKLEFMHILTRVNRKVATEFESFSLDSTFHAKKQIPCIVSMLTKELYF
YH 112. 2e12 scFv (SSS-P)H WCH2WCH3-mcasp3-TM/CT (SEQ ID NO: 453)
Nucleotide sequence:
aagcttatggattttcaagtgcagattttcagcttcctgctaatcagtgcttcagtcataatgtctccagaggagtcgacattgtgctcaccc
aatctccagcttcttttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctcggggtccctgcc
aggtttagtggcagtgggtctggacagacttcagcctcaacatccatcctgtggaggaggatgatattgcaatgtatttctgtcagc
aaaagtaggaaggttccttggacgttcggtggaggcaccaagctggaaatcaaacgggtggcggtggctcgggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctggagtggctgggaatgat
atggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacacatccccaccgtcccca
gcacctgaactcctgggtggaccgtcagtcttcctcttccccccaaaacccaaggacaccctcatgatctcccggacccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagccctcccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctcctgtctccgggtaaagcggatccttcgaacatggaga
acaacaaacctcagtggattcaaaatccattaataattttgaagtaaagaccatacatgggagcaagtcagtggactctgggatcta
tctggacagtagttacaaaatggattatcctgaaatgggcatatgcataataattaataataagaacttccataagagcactggaatgt
catctcgctctggtacggatgtggacgcagccaacctcagagagacattcatgggcctgaaataccaagtcaggaataaaaatgat
cttactcgtgaagacattttggaattaatggatagtgtttctaaggaagatcatagcaaaaggagcagctttgtgtgtgattctaagc
catggtgatgaagggtcattttatgggacaaatgggcctgttgaactgaaaaagttgactagcttcttcagaggcgactactgccgg
agtctgactggaaagccgaaactcttcatcattcaggcctgccggggtacggagctggactgtggcattgagacagacagtggga
ctgatgaggagatggcttgccagaagataccggtggaggctgacttcctgtatgcttactctacagcagcacctggttactattcctggag
aaattcaaaggacgggtcgtggttcatccagtccctttgcagcatgctgaagctgtacgcgcacaagctagaatttatgcacattctc
actcgcgttaacaggaaggtggcaacggaattcgagtccttctccctggactccactttccacgcaaagaaacagatcccgtgtatt
gtgtccatgctcacgaaagaactgtacttttatcactagctcgagatcgatg Amino acid sequence (SEQ ID NO: 454):
MDFQVQIFSFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMBSLQTDDTARYYCARDGYSNFHYYVMDYWGQGTSVTVSSDLEPKS
SDKTHTSPPSPAPELLGGPSVFLFPPKPKDTLMISRTPEVTCVVVDVSHEDPEVKFN
WYVDGVEVHNAKTKPREEQYNSTYRVVSVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMENNKTSVDSKSINNFEVKTIHGSKSVDSGIYLDSSYKMDYPEMD
ICIIINNKNFHKSTGMSSRSGTDVDAANLRETFMGLKYQVRNKNDLTREDILELMD
SVSKEDHSKRSSFVCVILSHGDEGVIYGTNGPVELKKLTSFFRGDYCRSLTGKPKLF
IIQACRGTELDCGIETDSGTDEEMACQKIPVEADFLYAYSTAPGYYSWRNSKDGS
WFIQSLCSMLKLYAHKLEFMHILTRVNRKVATEFESFSLDSTFHAKKQIPCIVSMLT
KELYFYH 113. 2e12 scFv (SSS-P)H P238SCH2WCH3-mcasp3-TM/CT (SEQ ID NO: 455)
Nucleotide sequence:
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctgagtggctgggaatgat
atgggggtgatgaagcacagactataattcagctctcaaatccagactgagcatcaccaaggacaactccaagagccaagttttctt
aaaaatgaacagtctgcaaactgatgacacagccagatactgtgccagagatggtttatagtaactttcattactatgttatggact
actggggtcaaggaacctcagtcaccgtctcctcagatctgagcccaaatcttctgacaaaactcacacatccccaccgtccca
gcacctgaactcctgggtgatcgtcagtcttcctcttccccaaaacccaaggacaccctcatgatctcccggacccctgaggtc
acatgcgtggtggtggacgtgagccacgaagaccctgaggtcaagttcaactggtacgtggacggcgtggaggtgcataatgcc
aagacaagccgcggggaggagcagtacaacagcacgtaccgtgtggtcagcgtcctcaccgtcctgcaccaggactggctgaa
tggcaaggagtacaagtgcaaggtctccaacaaagccctcccagcccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacaxgcagaagagcctctccctgtctccggtaaacggatccttcgaattcgaacatgg
agaacaacaaaacctcagtggattcaaaatccattaataattttgaagtaaagaccatacatggagcaagtcagtggactctggga
tctatctggacagtagttacaaaatggattatcctgaaatgggcatatgcataataatttaataataagaacttcataagagcactgga
atgtcatctcgctctggttacggatgtggacgcagccaacctcagagagacattcatgggcctgaaataccaagtccaggaataaaaa
tgatccttactcgtgaagacattttggaattaatggatagtgtttcttaaggaagatcatagcaaaaggagcagcttttgtgtgtgttattcta
agccatggtgatgaaggggtcatttatgggacaaatgggcctgttgaactgaaaagttgactagcttcttcagaggcgcatactgc
cggagtctgactggaaagccgaaactcttcatcattcaggcctgccgggtacggagctggactgtggcattgagacagacagtg
ggactgatgaggagatggcttgccagaagataccggtggaggctgacttcctgtatgcttactctacagcacctggttactattcctg
gagaaattcaaaggacgggtcgtggttcatccagtccctttgcagcatgctgaagctgtacgcgcacaagctagaatttatgcacatt
ctcactcgcgttaacaggaaggtggcaacggaattcgagtccttctccctggactccactttccacgcaaagaaacagatcccgtgt
attgtgtccatgctcacgaaagaactgtactttatcactagctcgagatcgatcgatga Amino acid sequence (SEQ ID NO: 456):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYMGQGTSVTVSSDLEPKS
SDKTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNSNMENNKTSVDSKSINNFEVKTIHGSKSVDSGIYLDSSYKMDYPE
MGICIIINNKNFHKSTGMSSRSGTDVDAANLRETFMGLKYQVRNKNDLTREDILEL
MDSVSKEDHSKRSSFVCVILSHGDEGVIYGTNGPVELKKLTSFFRGDYCRSLTGKP
KLFIQACRGTELDCGIETDSGTDEEMACQKIPVEADFLYAYSTAPGYYSWRNSKD
GSWFIQSLCSMLKLYAHKLEFMHILTRVNRKVATEFESFSLDSTFHAKKQIPCIVSM
LTKELYFYH 114. mcasp8-TM/CT (SEQ ID NO: 457)
Nucleotide sequence:
ttcgaacatggatttccagagttgtctttatgctattgctgaagaactgggcagtgaagacctggctgccctcaagttcctgtgcttgga
ctacatcccacacaagaagcaggagaccatcgaggatgcccagaagctatttctgaggctgcgggaaaagggggatgttggagga
aggcaatctgtcttttcctgaaagagctgctttccacatcagtcggtgggacctgctggtcaacttcctagactgcaaccgagagga
gatggtgagagagctgcgggatccagacaatgcccagatttctccctaccagttctcctcaagctctcagagaagtgagcg
agttggaattgagatctttttaagttcctttttgaacaatgagatccccaaatgtaagctggaagatgacttgagcctgcttgaaattttgta
gaaatggagaagaggaccatgctggcagaaataacttggaaacccaaaatcaatctgtgaccaggtcaacaagagcctgctgg
ggaagatcgaggattatgaaggatcaagcacagagaagaatgagccttgaaggaagggaagagttgccaccttcagttttgga
tgagatgagcctcaaaatgccgaactgtgtgactcgcaagaagaaacagtgagtcacggacttcagacaaagtttaccaa
atgaagaacagaaaaggaacagactgtgataaagaggctctgagtaagacccttaaggagcttcattttgagatagtatccttacga
cgactgcactgcaaatgaaatccacgagattctagaaggctaccaaagcgcagaccacaagaacaaagactgcttcatctgctgta
tcctatcccacggtgacaagggtgtcgtctatggaacggatgggaaggaggcctccatctatgacctgacatcttacttcactggttc -continued

```
aaagtgcccttccctgtctgggaaacccaagatcttttcattcaggcttgccaaggaagtaacttccagaaaggagtgcctgatgag
gcaggcttcgagcaacagaaccacactttagaagtggattcatcatctcacaagaactatattccggatgaggcagactttctgctg
ggaatggctacggtgaagaactgcgtttcctaccgagatcctgtgaatgaacctggtatattcagtcactttgccagagcctgagg
gaaagatgtcctcaaggagatgacattcttagcatcctgactggcgtgaactatgacgtgagcaataaagacgacaggaggaaca
agggaaagcagatgccacagcccaccttcacactacggaagaagctcttcttccctccctaatgactcgagatcgatt
```

Amino acid sequence (SEQ ID NO: 458):
SNMDFQSCLYAIAEELGSEDLAALKFLCLDYIPHKKQETIEDAQKLFLRLREKGML
EEGNLSFLKELLFHISRWDLLVNTNFLDCREEMVRELRDPDNAQISPYRVMLFKLSE
EVSELELRSFKFLLNEIPKCKLEDDLSLLEIFVEMEKRTMLAENNLETLKSICDQV
NKSLLGKIEDYERSSTERRMSLEGREELPPSVLDEMSLKMAELCDSPREQDSESRTS
DKVYQMKNKPRGYCLIINNHDFSKAREDITQLRKMKDRKGTDCDKEALSKTFKEL
HFEIVSYDDCTANEIHEILEGYQSADHKNKDCFICCILSHGDKVVYGTDGKEASIY
DLTSYFTGSKCPSLSGKPKIFFIQACQGSNFQKGVPDEAGFEQQNHTLEVDSSSHKN
YIPDEADFLLGMATVKNCVSYRDPVNGTWYIQSLCQSLRERCPQGDDILSILTGVN
YDVSNKDDRRNKGKQMPQPTFTLRKKLFFPP 115. 2e12 scFv hIgG1 (SSS-P)H WCH2 WCH3-mcasp8-TM/CT (SEQ ID NO: 459)
Nucleotide sequence:
```
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaaagtaggaaggttcctggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggtttctcattaaccggctatggtgtaaactggttcgccagcctccaggaaagggtctgagtggctgggaatgat
atggggtgatggaagcacagactataattcagctctcaaatccgagctgagcatcaccaaggacaacctccaagagccaagttttctt
aaaaatgaacagtctgcaaactgatgacacagccagatactactgtgccagagatggttatagtaactttcattactatgttatggact
actggggtcaaggaaccctcagtcaccgtctcctcagatctggagcccaaatcttctgacaaaactcacacatccccaccgtcccca
gcacctgaacctcctgggtggaccgtcagtcttcctcttccccccaaaaccaaggacaccctcatgatctcccggaccctgaggt
cacatgcgtggtggtggacgtgagccacgaagaccctgaggtcaagttcaactggtacgtggacggcgtggaggtgcataatgc
caaagacaaagccgcgggaggagcagtacaacagcacgtaccgtgtggtcagcgtcctcaccgtcctgcaccaggactggctga
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaagcggatccttcgaacatggatttc
cagagttgtctttatgctattgctgaagaactgggcagtgaagacctggctgccctcaagttcctgtgcttggactatccccacaca
agaagcaggagaccatcgaggatgcccagaaagctatttctgaggctgcgagtgttggaggaaggcaatctgtctttt
cctgaaagagctgctttttccacatcagtcggtgggacctgctggtcaacttcctagactgcaaccgagaggagatggtgagagagc
tgcgggatccagacaatgcccagatttctccctacagggtcatgctctttaagctctcagaagaagtgagcgagttggaattgagat
cttttaagttccttttgaacaatgagatccccaaatgtaagctggaagatgacttgagcctgcttgaaatttgtagaaatggagaaga
ggaccatgctggcagaaaataacttggaaaaccctaaaatcaatctgtgaccaggtcaacaagagcctgctggggaagatcgaag
attatgaaaagatcaagcacagagagaagaatgagccttgaaggaaggggaagagttgccaccttcagtttttggatgagatgagcctc
aaaaatggcggactgtgtgactcgccaagagaacaagacagtgagtcacggacttcagacaaaagtttaccaaatgaagaacaaa
cctcggggatactgtctgatcatcaacaatcatgatttcagcaaggcccgggaagacataaccccaactccgaaaaatgaaggaca
gaaaaggaacagactgtgataaagaggctctgagtaagacctaaggaagcttcattttgagatagtatcttacgacgactgcactgc
aaatgaaatccacgagattctagaaggctaccaaagcgcagaccacaagaacaaagactgcttcatctgctgtatcctatcccacg
gtgacaagggtgtcgtctatgaacggatgggaaggaggcctccatctatgacctgacatcttacttcactggttcaaagtgcccttc
cctgtctgggaaacccaagatcttttcattcaggcttgccaaggaagtaacttccagaaaggagtgcctgatgaggcaggcttcga
gcaacagaaccacactttagaagtggattcatcatctcacaagaactatattccggatgaggcagactttctgctgggaatggctac
ggtgaagaactgcgtttcctaccgagatcctgtgaatgaacctggtatattcagtcactttgccagagcctgagggaaagatgtcct
caaggagatgacattcttagcatcctgactggcgtgaactatgacgtgagcaatggggacgacgaggaacaagggaagcag
atgccacagcccaccttcacactacggaagaagctcttcttccctccctaatgactcgagatcgatt
```

Amino acid sequence (SEQ ID NO: 460):
MDFQVQIFSFLLISASVIMSRGVDIVLTTQSPASLAVSLGQRATISCRASESVEYYVTS
LMQWYQQKPGQPPKLLISAASNVESGVPARFSGSGSGTDFSLNIHPVEEDDIAMYF
CQQSRKPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSQGTSVTVSSDLEPKS
SDKTHTSPPSPAPELLGGPSVFLFPPKPKDTLMISRTPEVTCVVVDVSHEDPEVKFN
WYVDGVEVHNAKTKLPREEQYNSTYRVVSVLTVLHQDWLNGKEYKCKVSNTKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMDFQSCLYAIAEELGSEDLAALKFLCLDYIPHKKQETIEDAQKLFL
RLREKGMLEEGNLSFLKELLFHISRWDLLVNFLDCNREEMVRELRDNAQISPYR
VMLFKLSEEVSELELRSFKFLLNNEIPKCKLEDDLSLLEIFVEMEKRTMLAENNLET
LKSICDQVNKSLLGKIEDYERSSTERRMSLEGREELPPSVLDEMSLKMAELCDSPR
EQDSESRTSDKVYQMKNKPRGYCLIINNHDFSKAREDITQLRKMKDRKGTDCDKE
ALSKTFKELHFEIVSYDDCTANEIHEILEGYQSADHKNKDCFICCILSHGDKVVYG
TDGKEASIYDLTSYFTGSKCPSLSGKPKIFFIQACQGSNFQKGVPDEAGFEQQNHTL
EVDSSSHKNYIPDEADFLLGMATVKNCVSYRDPVNGTWYIQSLCQSLRERCPQGD
DILSILTGVNYDVSNKDDRRNKGKQMPQPTFTLRKKLFFPP 116. 2e12 scFv hIgG1 (SSS-P)H P238SCH2 WCH3-mcasp8-TM/CT (SEQ ID NO: 461)
Nucleotide sequence:
```
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
```

-continued

```
aaagtaggaaggttccttggacgttcggtggaggcaccaagctggaaatcaaacggggtggcggtggctcgggcggaggtggg
tcgggtggcggcggatctcaggtgcagctgaaggagtcaggacctggcctggtggcctggtggcgcccgcacagagcctgtccatcacatgc
accgtctcagggttctcattaaccggctatggtgtaaactgggttcgccagcctccaggaaagggtctggagtggctgggaatgat
atgggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacatcccccaccgtcccca
gcacctgaactcctgggtggatcgtcagtcttcctcttcccccaaaacccaaggacacccTcatgatctcccggacccctgaggtc
acatgcgtggtggtggacgtgagccacgaagaccctgaggtcaagttcaactggtacgtggacggcgtggaggtgcataatgcc
aagacaaagccgcgggaggagcagtacaacagcacgtaccgtgtggtcagcgtcctcaccgtcctgcaccaggactggctgaa
tggcaaggagtacaagtgcaaggtctccaacaaagcccTcccagcccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaagcggatccttcgaacatggatttcc
agagtttgtctttatgctattgctgaagaactgggcagtgaagacctggctgccctcaagttcctgtgcttggactacatcccacacaa
gaagcaggagaccatcgaggatgcccagaagctatttctgaggctgcgggaaaagggggatgttggaggaaggcaatctgtctttc
ctgaaagagctgcttttccacatcagtcggtgggacctgctggtcaacttcctagactgcaaccgagaggagagtggtgagagct
gcgggatccagacaatgcccagatttctccctacagggtcatgctctcttaagctctcagaagaagtgagcgagttgagattgagatc
tttttaagttcctttgaacaatgagatccccaaatgtaagctggaagatgacttgagcctgcttgaaattttttgtagaaatggagaagag
gaccatgctggcagaaaataacttggaaaccctaaaatcaatctgtgaccaggtcaacaagagcctgctggggaagatcgaggat
tatgaaagatcaagcacagagagaagaatgagccttgaaggaagggaagagttgccaccttcagttttggatgagatgagcctca
aaatggcggaactgtgtgactcgccaagagaacaagacagtgagtcacggacttcagacaaagttaccacctgaagaacaaac
ctcggggatactgtctgatcatcaacaatcatgatttcagcaaggcccgggaagacataaccCaactccgaaaaatgaaggacag
aaaaggaacagactgtgataaagaggctctgagtaagacctttaaggagcttcattttgagatagtatcttacgacgactgcactgca
aatgaaatccacagagattctagaaaggctaccaaagcgcagaccacaagaacaaagactgcttcatctgctgtatcctatcccacgg
tgacaagggtgtcgtctatggaaccgatgggaagaggcctcatctatgacctgacctcttacttcactggttcaaagtgcccttcc
ctgtctgggaaacccaagatcttttttcattcaggcttgccaaggaagtaacttccagaaaggagtgcctgatgaggcaggcttcgag
caacagaaccacactttagaagtggattcatcatctcacaagaactatattccggatgaggcagactttctgctgggaatggctacg
gtgaagaactgcgtttcctaccgagatcctgtgaatggaacctggtatattcagtcactttgccagagcctgagggaaagatgtcctc
aaggagatgacattcttagcatcctgactggcgtgaactatgacgtgagcaataaagacgacaggaggaacaaggaaagcaga
tgccacagccccttcacactacggaagaagctcttcttccctcctaatgactcgagatcgattc
```

Amino acid sequence (SEQ ID NO: 462):
MDFQVQIFSFLLISASVIMSRGVDIVLTQSPASLAVSLGQRATISCRASESVEYYVTS
LMQWYQQKPGQPPKLLISASNVESGVPARFSGSGSGTDFSLNIHPVEEDDIAMYF
CQQSRKVGWTFGGGTKLEIKRGGGSGGGGSGGGGSQVQLKESGPGLVAPSQSLS
ITCTVSGFSLTGYGVNWVRQPPGKGLEWLGNIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMDFQSCLYAIAEELGSEDLAALKFLCLDYIPHKKQETIEDAQKLFL
RLREKGMLEEGNLSFLKELLFHISRWDLLVNFLDCNREEMVRELRDPDNAQISPYR
VMLFKLSEEVSELELRSFKFLLNNEIPKCKLEDDLSLLEIFVEMEKRTMLAENNLET
LKSICDQVNKSLLGKIEDYERSSTERRMSLEGREELPPSVLDEMSLKMAELCDSPR
EQDSESRTSDKVYQMKNKPRGYCLIINNHDFSKAREDITQLRKMKDRKGTDCDKE
ALSKTFKELHFEIVSYDDCTANEIHEILEGYQSADHKNKDCFICCILSHGDKGVVYG
TDGKEASIYDLTSYFTGSKCPSLSGKPKIFFIQACQGSNFQKGVPDEAGFEQQNHTL
EVDSSSHYPDEADFLLGMATVKNCVSYRDPVNGTWYIQSLCQSLCQSLRERCPQGD
DILSILTGVNYDVSNKDDRRNKGKQMPQPTFTLRKKLFFPP 117. hcasp3-TM/CT (SEQ ID NO: 463)
Nucleotide sequence:
```
Ggatccttcgaacatggagaacactgaaaactcagtggattcaaaatccattaaaaatttggaaccaaagatcatacatggaagcg
aatcaatggactctggaatatccctggacaacagttataaaatgattatcctgagatgggtttatgtataataattaataataagaattttt
cataaaagcactggaatgacatctcggtctggtacagatgtcgatgcagcaaacctcagggaaacattcagaaaacttgaaatatga
agtcaggaataaaaatgatcttacacgtgaagaaattgtggaattgatgcgtgatgtttctaaagaagatcacagcaaaaggagcag
ttttgtttgtgcttctgagccatggtgaagaaatttttgagaccaatgggccagtggacttgaaaaaataacaaactttttc
agaggggatcgttgtagaagtctaactggaaaacccaaactttttcattattcaggcgtgccgtggtacagaactggactgtggcattg
agacagacagtggtgttgatgatgacatgcgtgtcataaaataccagtggaccgacttcttgtatgcatactccacagcacctg
gttattattcttggcgaaattcaaaggatggctcctggttcatccagtcgctttgtgccatgctgaaacagtatgccgacaagcttgaat
ttatgcacattcttacccgggttaaccgaaaggtggcaacagaatttgagtcctttccttgacgctacttttcatgcaaagaaacaga
ttccatgtattgtttccatgctcacaaaagaactctatttttatcactaactcgagatcgata
```

Amino acid sequence (SEQ ID NO: 464):
DPSNMENTENSVDSKSIKNLEPKIIHGSESMDSISLDNSYKMDYPEMGLCIIINNK
NFHKSTGMTSRSGTDVDAANLRETFRNLKYEVRNKNDLTREEIVELMRDVSKED
HSKRSSFVCVLLSHGEEGIIFGTNGPVDLKKITNFFRGDRCRSLTGKPKLIIQACRG
TELDCGIETDSGVDDDMACHKIPVEADFLYAYSTAPGYYSWRNSKDGSWFIQSLC
AMLKQYADKLEFMHILTRVNRKVATEFESFSFDATFHAKKQIPCIVSMLTKELYFY
H 118. 2e12 scFv hIgG1 (SSS-P)H WCH2 WCH3-hcasp3-TM/CT (SEQ ID NO: 465)
Nucleotide sequence:
```
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatatatgtcacaagtt
taatgcagtggtaccaacagaaaccaggacagccacccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcgggcggaggtggg
```

-continued
tcgggtggcggcggatctcaggtgcagctgaaggagtcaggacctggcctggtggcgccctcacagagcctgtccatcacatgc
accgtctcagggttctcattaaccggctatggtgtaaactgggttcgccagcctccaggaaagggtctggagtggctgggaatgat
atgggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaaactcacacatccccaccgtcccca
gcacctgaactcctgggtggaccgtcagtcttcctcttccccccaaaacccaaggacaccctcatgatctcccggacccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctgaa
tggcaaggagtacaagtgcaaggtctccaacaaagcccctcccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaagcggatccttcgaacatggaga
acactgaaaactcagtggattcaaaatccattaaaaatttggaaccaaagatcatacatggaagcgaatcaatggactctgaatatc
cctggacaacagttataaaatggattatcctgagatgggtttatgtataataattaataataagaattttcataaaagcactggaatgaca
tctcggtctggtacagatgtcgatgcagcaaacctcagggaaacattcagaaacttgaaatatgaagtcaggaataaaaatgatctta
cacgtgaagaaattgtggaattgatgcgtgatgtttctaaagaagatcacagcaaaaggagcagttttgtttgtgttcttctgagccat
ggtgaagaaggaataattttttggaacaaatggacctgttgacctgaaaaaaataacaaacttttttcagaggggatcgttgtagaagtc
taactggaaaacccaaacttttcattattcaggcctgccgtggtacagaactggactgtggcattgagacagacagtggtgattgatga
tgacatggcgtgtcataaaataccagtggaggccgacttcttgtatgcatactccacagcacctggttattattcttggcgaaattcaa
aggatggctcctggttcatccagtcgcttgcctcatgctgaaacagtatgccgacaagcttgaatttatgcacattcttacccgggtta
accgaaaggtggcaacagaatttgagtccttttccttttgacgctactttttcatgcaaagaaacagattccatgtattgtttccatgctcac
aaaagaactctatttttatcactaactcgagatcgata Amino acid sequence (SEQ ID NO: 466):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMENTENSVDSKSIKNLEPKIIHGSESMDSGISLDNSYKMDYPEMG
LCIIINNKNFHKSTGMTSRSGTDVDAANLRETFRNLKYEVRNKNDLTREEIVELMR
DVSKEDHSKRSSFVCVLLSHGEEGIIFGTNGPVDLKIKITNFFRGDRCRSLTGKPKLFI
IQACRGTELDCGIETDSGVDDDMACHKIPVEADFLYAYSTAPGYYSWRNSKDGS
WFIQSLCAMLKQYADKLEFMHILTRVNRKVATEFESFSFDATFHAKKQIPCIVSML
TKBLYFYH 123. 2e12 scFv hIgG1 (SSS-P)H P238SCH2 WCH3-hcasp3-TM/CT (SEQ ID NO: 467)
Nucleotide sequence:
aagcttatggatttttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatatattgtcacaagtt
taatgcagtggtaccaacagaaaccaggacagccaccaaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacgggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatggaaactgggttcgccagcctccaggaaagggtctggagtggctgggaatgat
atgggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaaactcacacatccccaccgtcccca
gcacctgaactcctgggtggatcgtcagtcttcctcttccccccaaaacccaaggacaccctcatgatctcccggacccctgaggtc
acatgcgtggtggtggacgtgagccacgaagaccctgaggtcaagttcaactggtacgtggacggcgtggaggtgcataatgcc
aagacaaagccgcgggaggagcagtacaacagcacgtaccgtgtggtcagcgtcctcaccgtcctgcaccaggactggctgaa
tggcaaggagtacaagtgcaaggtctccaacaaagcccctcccagccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaagcggatccttcgaacatggagaac
actgaaaactcagtggattcaaaatccattaaaaatttggaaccaaagatcatacatggaagcgaatcaatggactctgaatatccc
tggacaacagttataaaatggattatcctgagatgggtttatgtataataattaataataagaatttttcataaaagcactggaatgacatc
tcggtctggtacagatgtcgatgcagcaaacctcagggaaacattcagaaacttgaaatatgaagtcaggaataaaaatgatcttac
acgtgaagaaattgtggaattgatgcgtgatgtttctaaagaagatcacagcaaaaggagcagttttgtttgtgttcttctgagccatg
gtgaagaaggaataattttttggaacaaatggacctgttgacctgaaaaaaataacaaacttttttcagaggggatcgttgtagaagtct
aactggaaaacccaaacttttcattattcaggcctgccgtggtacagaactggactgtggcattgagacagacagtggtgattgat
gacatggcgtgtcataaaataccagtggaggccgacttcttgtatgcatactccacagcacctggttattattcttggcgaaattcaa
aggatggctcctggttcatccagtcgcttgccatgctgaaacagtatgccgacaagcttgaatttatgcacattcttacccgggttaa
ccgaaaggtggcaacagaatttgagtccttttcctttgacgctactttttcatgcaaagaaacagattccatgtattgtttccatgctcaca
aaagaactctatttttatcactaactcgagatcgataa Amino acid sequence (SEQ ID NO: 468):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVIFLKMNSLQTDDTARYYCARDGYSNFHYYVMDYWGQGTSVTVSSDLEPKS
SDKTHTSPPSPAPELLGGSVFLFPPKPKDTLMISRTPEVTCVVVDVSHEDPEVKFN
WYVDGVBVHNAKTKPREEQYNSTYRVVSVLTVLHQDWLNGKEYKCKVSNKALP

```
-continued
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMENTENSVDSKSIKNLEPKIIHGSESMDSGISLDNSYKMDYPEMG
LCIIINNKNFHKSTGMTSRSGTDVDAANLRETFRNLKYEVRNKIWLTREEIVELMR
DVSKRDHSKRSSFVCVLLSHGEEGIIFGTNGPVDLKKITNFFRGDRCRSLTGKPKLFI
IQACRGTELDCGIETDSGVDDDMACHKIPVEADFLYAYSTAPGYYSWRNSKDGS
WFIQSLCAMLKQYADKLEFMHILTRVNRKVATEFESFSFDATFHAKKQIPCIVSML
TKELYFYH 124. hcasp8-TM/CT (SEQ ID NO: 469)
hCaspase8B:
Nucleotide sequence:
ggatccttcgaacatggactttcagcagaaatctttatgatattggggaacaactggacagtgaagatctggcctccctcaagttcctg
agcctggactacattccgcaaaggaagcaagaacccatcaaggatgccttgatgttattccagagactccaggaaaagagaatgtt
ggaggaaagcaatctgtccttcctgaaggagctgctcttccgaattaatagactggatttgctgattacctacctaaacactagaaag
gaggagatggaaagggaacttcagacaccaggcagggctcaaatttctgcctacagggtcatgctctatcagatttcagaagaagt
gagcagatcagaattgaggtcttttaagtttctttttgcaagaggaaatctccaaatgcaaactggatgatgacatgaacctgctggata
ttttcatagagatggagaagaggggtcatcctgggagaaggaaagtttggacatcctgaaaagagtctgtgcccaaatcaacaagag
cctgctgaagataatcaacgactatgaagaattcagcaaagagagaagcagcagccttgaaggaagtcctgatgaattttcaaatg
ggggaggagtgtggggtaatgacaatctcggactctccaagagaacaggatagtgaatcacagactttggacaaagtttaccaa
atgaaaagcaaacctcgggatactgtctgatcatcaacaatcacaattttgcaaaagcacgggagaaagtgcccaaacttcacag
cattagggacaggaatggaacacacttggatgcaggggctttgaccacgaccttttgaagagcttcattttgagatcaagccccacg
atgactgcacagtagagcaaatctatgagattttgaaaatctaccaactcatgaccacagtaacatggactgcttcatctgctgtatc
ctctcccatggagacaagggcatcatctatggcactgatggacaggaggcccccatctatgagctgacatctcagttcactggtttg
aagtgccctccctgctgaaaaacccaaagtgtttttattcaggcttgtcaggggataactaccagaaaggtatacctgttgagac
tgattcagaggagcaaccctatttagaaatggatttatcatcacctcaaacgagatatatccaaacggagatatatccagtgactttctgctgggg
atggccactgtgaataactgtgttttcctaccgaaaccctgcagagggaacctggtacatccagtcacttgcccagagcctgagaga
gcgatgtcctcgaggcgatgatattctcaccatcctgactgaagtgaactatgaagtaagcaacaaggatgacaagaaaaacatgg
ggaaacagatgcctcagcctactttcacactaagaaaaaaacttgtcttcccttctgattgagcatgcatcgata Amino acid sequence (SEQ ID NO: 470):
DPSNMDFSRNLYDIGEQLDSEDLASLKFLSLDYIPQRKQEPIKDALMLFQRLQEKR
MLEESNLSFLKELLFRINRLDLLITYLNTRKLEEMERELQTPGRAQISAYRVMLYQIS
EEVSRSELRSFKFLLQEEISKCKLDDDMNLLDIFIEMEKRVILGEGKLDILKRVCAQI
NKSLLKIINDYEEFSKERSSSLEGSPDEFSNGEELCGVMTISDSPREQDSESQTLDKV
YQMKSKPRGYCLIINNHNFAKAREKVPKLHSIRDRNGTHLDAGALTTTFEELHFEI
KPHIDDCTVEQIYEILKIYQLMDHSNMDCFICCILSHGDKGIIYGTDGQEAPIYELTS
QFTGLKCPSLAGKPKVFFIQACQGDNYQKGIPVETDSEEQPYLEMDLSSPQTRYIPD
EADFLLGMATVNNCVSYRNPAEGTWYIQSLCQSLRERCPRGDDILTILTEVNYEVS
NKDDKKNMGKQMPQPTETLRKKLVFPSD hCaspase8C:
Nucleotide sequence (SEQ ID NO: 471):
ggatccttcgaacatggacttcagcagaaatctttatgatattggggaacaactggacagtgaagatctggcctccctcaagttcctg
agcctggactacattccgcaaaggaagcaagaacccatcaaggatgccttgatgttattattccagagactccaggaaaagagaatgtt
ggaggaaagcaatctgtccttcctgaaggagctgctcttccgaauaatagactggatttgctgattacctacctaaacactagaaag
gaggagatggaaagggaacttcagacaccaggcagggctcaaatttctgcctacagggtcatgctctatcagatttcagaagaagt
gagcagatcagaattgaggtcttttaagtttctttttgcaagaggaaatctccaaatgcaaactggatgatgacatgaacctgctggata
ttttcatagagatggagaagaggggtcatcctgggagaaggaaagttggacatcctgaaaagagtctgtgcccaaatcaacaagag
cctgctgaagataatcaacgactatgaagaattcagcaaaggggaggagttgtgtggggtaatgacaatctcggactctccaagag
aacaggatagtgaatcacagactttggacaaagtttaccaaatgaaaagcaaacctcgggatactgtctgtctgatcatcaacaatcaca
atttttgcaaaagcacgggagaaagtgcccaaacttcacagcattagggacaggaatggaacacacttggatgcaggggctttgac
cacgacctttgaagagcttcattttgagatcaagccccacgatgactgcacagtagagcaaatctatgagattttgaaaatctaccaa
ctcatgaccacagtaacatggactgcttcatctgctgtatcctctcccatggagacaagggcatcatctatggcactgatggacag
gaggcccccatctatgagctgacatctcagttcactggttttgaagtgccctccctgctggaaaaccaaagtgttttttattcaggctt
gtcaggggataactaccagaaaggtatacctgttgagactgattcagaggagcaaccctatttagaaatggatttatcatcacctca
aacgagatatatcccggatgaggctgactttctgctggggatggccactgtgaataactgtgttttcctaccgaaaccctgcagaggg
aacctggtacatccagtcactttgccagagcctgagagagcgatgtcctcgaggcgatgatattctcaccatcctgactgaagtgaa
ctatgaagtaagcaacaaggatgacaagaaaaacatggggaaacagatgcctcagcctactttcacactaagaaaaaaacttgtct
tcccttctgattgagcatgcatcgata Amino acid sequence (SEQ ID NO: 472):
DPSNMDFSRNLYDIGEQLDSEDLASLKFLSLDYIPQRKQEPIKDALMLFQRLQEKR
MLEESNLSFLKELLFRINRLDLLITYLNTRKEEMERELQTPGRAQISAYRVMLYQIS
EEVSRSELRSFKFLLQEEISKCKLDDDMNLLDIFIEMEKRVILGEGKLDILKRVCAQI
NKSLLKIIDYEEFSKGEELCGVMTISDSPREQDSESQTLDKVYQMKSKPRGYCLII
NNHNFAKAREKVPKLHSIRDRNGTHLDAGALTTTFEELHFEIKPHDDCTVEQIYEIL
KIYQLMDHSNMDCFICCILSHGDKGIIYGTDGQEAPIYELTSQFTGLKCPSLAGKPK
VFFIQACQGDNYQKGIPVETDSEEQPYLEMDLSSPQTRYTIPDEADFLLGMATVNNC
VSYRNPAEGTWYIQSLCQSLRERCPRGDDILTILTEVNYEVSNKDDKKNMGKQMP
QPTFTLRKKLVFPSD 125. 2e12 scFv hIgG1 (SSS-P)H WCH2 WCH3-hcasp8-TM/CT
Nucleotide sequence (SEQ ID NO: 473):
aagcttatggattttcaagtgcagattttcagcttcctgctaatcagtgcttcagtcataatgtccagaggatcgacattgtgctcaccc
aatctccagcttcttttggctgtgtctctaggtcagagagccaccatctcctgcagagccagtgaaagtgttgaatattatgtcacaagtt
taatgcagtggtaccaacagaaaccaggacagccacccaaactcctcatctctgctgcatccaacgtagaatctgggtccctgcc
aggtttagtggcagtgggtctgggacagacttcagcctcaacatccatcctgtggaggaggatgatattgcaatgtattttctgtcagc
aaagtaggaaggttccttggacgttcggtggaggcaccaagctggaaatcaaacgggtggcggtggctcgggcggaggtggg
tcgggtggcggcggatctcaggtgcagctgaaggagtcaggacctggcctggtggcgccctcacagagcctgtccatcacatgc
```

-continued

```
accgtctcagggttctcattaaccggctatggtgtaaactgggttcgcagcctccaggaaagggtctggagtggctgggaatgat
atggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacacatccccaccgtcccca
gcacctgaacctcctgggtggaccgtcagtcttcctcuccccccaaaaccaaggacaccctcatgatctcccggaccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagcccctcccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctctcatgctcc
gtgatgcatgaggctctgcacaaccactacacgcagaagagcctctccctgtctccgggtaaagcggatccttcgaacatggactt
cagcagaaatctttatgatattggggaacaactggacagtgaagatctggcctcccctcaagtcctgagcctggactacattccgca
cagcagaaatctttatgatattggggaacaactggacagtgaagatctggcctcccctcaagtcctgagcctggactacattccgca
tcctgaaggagctgctcttccgaattaatagactggatgctgattacctacctacctaaacactagaaaggaggagatggaaagggaac
ttcagacaccaggcagggctcaaatttctgcctacagggtcatgctctatcagaatttcagaagaagtgagcagatcagaattgaggt
cttttaagtttcttgcaagaggaaatctccaaatgcaaactggatgatgacatgaactgcttggatattttcatagagatggagaaga
gggtcatcctgggagaaggaaagttggacatcctgaaaagagcttgcccaaatcaacaagagcctgctgaagataatcaacga
ctatgaagaattcagcaaagagaagcagcagccttgaaggaagtcctgatgaattttcaaatggggaggagttgtgtggggtaa
tgacaatctcggactctccaagagaacaggatagtgaatcacagactttggacaaagtttaccaaatgaaaagcaaacctcggggda
tactgtctgatcatcaacaatcacaattttgcaaaagcacgggagaaagtgcccaaacttcacagcattagggacaggaatggaac
acacttggatgcaggggctttgaccacgacctttgaagagcttcattttgagatcaagccccacgatgactgtgacagtagagcaaat
ctatgagattttgaaaatctaccaactcatgaccacagtaacatggactgcttcatctgcttcatcctctcccatggagacaagggca
tcatctatggcactgatggacaggaggcccccatctatgagctgacatctcagttcactggtttgaagtgcccttcccttgctgaaa
acccaaagtgtttttattcaggcttgtcaggggataactaccagaaaggtatacctgttgagactgattcagaggagcaaccctatt
tagaaatggatttatcatcacctcaaacagatatatcccggatgaggctgacttttctgctggggatggccactgtgaataactgtgttt
tcctaccgaaacctgcagagggaacctggtacatccagtcacttttgccagagcctgagaggcgatgtcctcgaggcgatgatat
tctcaccatcctgactgaagtgaactatgaagcaagcaacaaggatgacaagaagaaaaacatggggaaaacagatgcctcagcctactt
tcacactaagaaaaaacttgtcttccttctgattgagcatgcatcgata
```

Amino acid sequence (SEQ ID NO: 474):
MFQVQWSFLLISASVIMSRGVDIVLTQSPASLAVSLGQRATISCPASESVEYYVTS
LMQWYQQKPGQPPKLLISAASNVESGVPARFSGSGSGTDFSLNIHPVEEDDIAMYF
CQQSRWTFGGGTKLEIKRGGGGSGGGGSGGGGSQVQLKESGPGLVAPLPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMDFSRNLYDIGEQLDSEDLASLKFLSLDYIPQRKQEPIKDALMLFQ
RLQEKRLEESNLSFLKELLFRINRLDLLITYLNTRKEEMERELQTPGRAQISAYRV
MLYQISEEVSRSELRSFKFLLQEEISKCKLDDDMNLLDIFIEMEKRVILGEGKLDILK
RVCAQINKSLLKIINDYEEFSKERSSSLEGSPDEFSNGEELCGVMTISDSPREQDSES
QTLDKVYQMKSKPRGYCLIINNHNFAKAREKVPKLHSIRDRNGTHLDAGALTTTF
EELHFEIKPHDDCTVEQIYEILKIYQLMDHSNMDCFICCILSHGDKGIIYGTDGQEAP
IYELTSQFTGLKCPSLAGKPKVFFIQACQGDNYQKGIPVETDSEEQPYLEMDLSSPQ
TRYIPDEADFLLGMATVNNCVSYRNPAEGTWYIQSLCQSLRERCPRGDDILTILTE
VNYEVSNKDDKKMGKQMPQPTFTLRKKLVFPSD 126. 2e12 scFv hIgG1 (SSS-P)H P238SCH2 WCH3-hcasp8B-TM/CT
(other caspase 8 isoforms are similar)
Nucleotide sequence (SEQ ID NO: 475):
```
aagcttatggattttcaagtgcagatttcagcttcctgctaatcagtgcttcagtcataatgtccagaggagtcgacattgtgcaccc
aatctccagcttctttggctgtgtctctaggtcagagagccaccatctcctgcagagccagtgaaagtgttgaatattatgtcacaagtt
taatgcagtggtaccaacagaaaccaggacagccaccaaaatcctcatctctgctgcatccaacgtagaatctggggtccctgcc
aggtttagtggcagtgggtctgggacagacttcagcctcaacatccatcctgtggaggaggatgatattgcaatgtatttctgtcagc
aaagtaggaaggttccttggacgttcggtggaggcaccaagctggaaatcaaacggggtggcggtggctcggcggaggtggg
tcgggtggcggcggatctcaggtgcagctgaaggagtcaggacctggcctggtggcgccctcacagagcctgtccatcacatgc
accgtctcagggttctcattaaccggctatgaaactgggtcgccagcctccaggaaagggtctggagtggctgggaatgat
atggggtgatggaagcacagactataattcagctctcaaatccagactgagcatcaccaaggacaactccaagagccaagttttctt
aaaaatgaacagtctgcaaactgatgacacagccagatactactgtgccagagatggttatagtaactttcattactatgttatggact
actggggtcaaggaacctcagtcaccgtctcctcagatctggagcccaaatcttctgacaaaactcacacatccccaccgtcccca
gcacctgaactcctgggtggatcgtcagtcttcctcttcccccccaaaacccaaggacaccctcatgatctcccggacccctgaggtc
acatgcgtggtggtggacgtgagccacgaagaccctgaggtcaagttcaactggtacgtggacggcgtggaggtgcataatgcc
aagacaaagccgcgggaggagcagtacaacagcacgtaccgtgttgtcagcgtcctcaccgtcctgcaccaggactggctgaa
tggcaaggagtacaagtgcaaggtctccaacaaagcccctcccagccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaagcggatccttcgaacatggacttca
gcagaaatctttatgatattggggaacaactggacagtgaagatctggcctcccctcaagtcctgagcctggactacattccgcaa
ggaagcaagaacccatcaaggatgccttgatgttattccagagactccaggaaaagagaatgttgaggaaagcaatctgtcctt
ctgaaggagctgctcttccgaattaatagactggatttgctgattacctacctaaacactagaaaggaggagatggaaagggaactt
cagacaccaggcagggctcaaatttctgcctacagggtcatgctctatcagatttcagaagaagtgagcagatcagaattgaggtct
tttaagtttcttgcaagaggaaatctccaaatgcaaactggatgatgacatgaactgcttggatattttcatagagatggagaagag
ggtcatcctgggagaaggaaagttggacatcctgaaaagagtctgtgcccaaatcaacaagagcctgctgaagataatcaacgac
tatgaagaattcagcaaagagaagcagcagccttgaaggaagtcctgatgaattttcaaatggggaggagttgtgtggggtaat
gacaatctcggactctccaagagaacaggatagtgaatcacagactttggacaaagtttaccaaatgaaaagcaaacctcggggat
actgtctgatcatcaacaatcacaattttgcaaaagcacgggagaaagtgcccaaacttcacagcattagggacaggaatggaaca
```

-continued cacttggatgcaggggctttgaccacgacctttgaagagcttcattttgagatcaagccccacgatgactgcacagtagagcaaatc
tatgagattttgaaaatctaccaactcatggaccacagtaacatggactgcttcatctgctgtatcctctcccatggagacaagggcat
catctatggcactgatggacaggaggcccccatctatgagctgacatctcagttcactggtttgaagtgcccttcccttgctggaaaa
cccaaagtgttttttattcaggcttgtcaggggataactaccagaaaggtatacctgttgagactgattcagaggagcaaccctattt
agaaatggatttatcatcacctcaaacgagatatatcccggatgaggctgacttttctgctggggatggccactgtgaataactgtgtt
cctaccgaaaccctgcagagggaacctggtacatccagtcactttgccagagcctgagagagcgatgtcctcgaggcgatgatatt
ctcaccatcctgactgaagtgaactatgaagtaagcaacaaggatgacaagaaaaacatggggaaacagatgcctcagcctacttt
cacactaagaaaaaacttgtcttcccttctgattgagcatgcatcgataa Amino acid sequence (SEQ ID NO: 476):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSRWTFGGGTKLEIRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNMDFSRLYIGEQLDSEDLASLKFLSLDYIPQRKQEPIKDALMLFQ
RLQEKRMLEESNLSFLKELLFRINRLDLLITYLNTRKEEMERELQTPGRAQISAYRV
MLYQISEEVSRSELSFKFLLQEEISKCKLDDDMNLLDIFIEMEKRVILGEGKLDILK
RVCAQINKSLLKIINDYEEFSKERSSSLEGSPDEFSNGEELCGVMTISDSPREQDSES
QTLDKVYQMKSPRGYCLIINNHNFAKAREKVPKLHSIRDRNGTHLDAGALTTTF
EELHFEIKPHDDCTVEQIYEILKIYQLMDHSNMDCFICCILSHGDKGIIYGTDGQEAP
IYELTSQFTGLKCPSLAGKPKVFFIQACQGDNYQKGIPVETDSEEQPYLEMDLSSPQ
TRYIPDEADFLLGMATVNCVSYRPAEGTWYIQSLCQSLRERCPRGDDILTILTE
VNYEVSNKDDKKNMGKQMPQPTFTLRKKLVFPSD 128. 2e12 scFv-hIgG1 (SSS-P)H WCH2 WCH3-hFADD-TM/CT
Nucleotide sequence (SEQ ID NO: 477):
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaaagtaggaaggttccttggacgttcggtggaggcaccaagctggaaatcaaacgggtggcggtgctcggcggaggtggg
tcgggtggcggcggatctcaggtgcagctgaaggagtcaggacctggcctggtggcgccctcacagagcctgtccatcacatgc
accgtctcagggttctcattaaccggctatggaaactgggtcgccagcctccaggaaagggtctggagtggctgggaatgat
atggggtgatggaagcacagactataattcagctctcaaatccagactgagcatcaccaaggacaactcaagagccaagttttctt
aaaaatgaacagtctgcaaactgatgacacagccagatactactgtggccagagatggttatagtaactttcattactatgttatggact
actggggtcaaggaacctcagtcaccgtctcctcagatctggagcccaaatcttctgacaaaactcacacatccccaccgtccca
gcacctgaactcctgggtggaccgtcagtcttcctcttccccccaaaacccaaggacaccctcatgatctcccggacccctgaggt
cacatgcgtggtggtggacgtgagccacgaagaccctgaggtcaagttcaactggtacgtggacggcgtggaggtgcataatgc
caagacaaagccgcgggaggagcagtacaacagcacgtaccgtgtggtcagcgtcctcaccgtcctgcaccaggactggctga
atggcaaggagtacaagtgcaaggtctccaacaaagcctccagccccatcgagaaaaccatctccaaagccaaagggcag
ccccgagaaccacaggtgtacaccctgcccccatcccgggatgagctgaccaagaaccaggtcagcctgacctgcctggtcaaa
ggcttctatcccagcgacatcgccgtggagtgggagagcaatgggcagccggagaacaactacaagaccacgcctcccgtgct
ggactccgacggctccttcttcctctacagcaagctcaccgtggacaagagcaggtggcagcaggggaacgtcttctcatgctcc
gtgatgcatgaggctctgcacaaccactacacgcagaagagcctctccctgtctccgggtaaagcggatccttcgaacccgttcct
ggtgctgctgcactcggtgtcgtccagcctgtcgagcagcgagctgaccgagctcaagttcctatgcctcgggcgcgtggggcaag
cgcaagctggagcgctgcagagcggcctagacctcttctccatgctgctggagcagaacgacctggagccggggcacaccga
gctcctgcgcgagctgctcgcctccctgcgggcgccacgacctgctgcgcggcgcgtcgacgacttcgaggcggggcggcc
ggggccgcgcctgggaagaagaccgttgcagcatttaacgtcatatgtgataatgtggggaaagattggagaaggctggctc
gtcagctcaaagtctcagacaccaagatcgacagcatcgaggacagataccccgcaacctgacagagcgtgtgcgggagtca
ctgagaatctggaagaacacagagaaggagaacgcaacagttggccacctggtggggctctcaggtcctgccagatgaacct
ggtggctgacctggtacaagaggttcagcaggcccgtgacctccagaacaggagtgggccatgtccccgatgtcatggaactc
agacgcatctacctccgaagcgtcctgataactcgagatcgataacaac Amino acid sequence (SEQ ID NO: 478):
MDFQVQIFSFLLISASVASRGVDLVLTQSPASLAVSLGQATISCRASESVEYYVTS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNWVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMHEALHNHYTQKSL
SLSPGKADPSNPFLVLLHSVSSSLSSSELTELKFLCLGRVGKRKLERVQSGLDLFSM
LLEQNDLEPGHTELLRELLASLRRHDLLRRVDDFEAGAAAGAAPGEEDLCAAFNV
ICDNVGKDWRRLARQLKVSDTKIDSIEDRYPRNLTERVRESLRIWKNTEKENATV
AHLVGALRSCQMNLVADLVQEVQQARDLQNRSGAMSPMSWNSDASTSEAS 129. 2e12 scFv-hIgG1 (SSS-P)H P238SCH2 WCH3-hFADD-TM/CT
Nucleotide sequence (SEQ ID NO: 479):
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtatttctgtcagc
aaaagtaggaaggttccttggacgttcggtggaggcaccaagctggaaatcaaacgggtggcggtggctcggcggaggtggg -continued
```
tcgggtggcggcggatctcaggtgcagctgaaggagtcaggacctggcctggtggcgccctcacagagcctgtccatcacatgc
accgtctcagggttctcattaaccggctatgaaactgggttcgccagcctccaggaaagggtctggagtggctgggaatgat
atgggggtgatggaagcacagactataattcagctctcaaatccagactgagcatcaccaaggacaactccaagagccaagttttctt
actggggtcaaggaacctcagtcaccgtctcctcagatctggagcccaaatcttctgacaaaactcacacatccccaccgtcccca
gcacctgaacctcctgggtggatcgtcagtcttcctcttccccccaaaacccaaggacaccctcatgatctcccggaccccctgaggtc
acatgcgtggtggtggacgtgagccacgaagaccctgaggtcaagttcaactggtacgtggacggcgtggaggtgcataatgcc
aagacaaagccgcgggaggagcagtacaacagcacgtaccgtgtggtcagcgtcctcaccgtcctgcaccaggactggctgaa
tggcaaggagtacaagtgcaaggtctccaacaaagcccctcccagcccccatcgagaaaaccatctccaaagccaaagggcagc
cccgagaaccacaggtgtacaccctgcccccatcccgggatgagctgaccaagaaccaggtcagcctgacctgcctggtcaaag
gcttctatcccagcgacatcgccgtggagtgggagagcaatgggcagccggagaacaactacaagaccacgcctcccgtgctg
gactccgacggctccttcttcctctacagcaagctcaccgtggacaagagcaggtggcagcaggggaacgtcttctcatgctccgt
gatgcatgaggctctgcacaaccactacacgcagaagagcctctccctgtctccgggtaaagcggatccttcgaacccgttcctgg
tgctgctgcactcggtgtcgtccagcctgtcgagcagcgagctgaccgagaagctcaagttcctatgcctcgggcgcgtgggcaagcg
caagctggagcgcgtgcagagcggcctagacctcttctccatgctgctggagcagaacgacctggagcccgggcacaccgagc
tcctgcgcgagctgctcgcctccctgcggcgccacgacctgctgcggcgcgtcgacgacttcgaggcgggggcggcggccgg
ggccgcgcctggggaagaagacctgtgtgcagcatttaacgtcatatgtgataatgtggggaaagattggagaaggctggctcgt
cagctcaaagtctcagacaccaagatcgacagcatcgaggacagataccccgcaacctgacagagcgtgtgcgggagtcact
gagaatctggaagaacacagagaaggagaacgcaacagtggcccacctggtggggggctctcaggtcctgccagatgaacctgg
tggctgacctggtacaagaggttcagcaggcccgtgacctccagaacaggagtggggccatgtccccgatgtcatggaactcag
acgcatctacctccgaagcgtcctgataactcgagatcgataacaac
```
Amino acid sequence (SEQ ID NO: 480):
MDFQVQIFSFLLISASVIMSRGVDIVLTQSPASLAVSLGQRATISCRASESVEYYVYS
LMQWYQQKPGQPPKLLISAASNVESGVPARFSGSGSGTDFSLNIHPVEEDDIAMYF
CQQSRKVPWTFGGGTKLEIKRGGGGSGGGGSGGGGSQVQLKESGPGLVAPSQSLS
ITCTVSGFSLTGYGVNMVRQPPGKGLEWLGMIWGDGSTDYNSALKSRLSITKDNS
KSQVFLKMNSLQTDDTARYYCARDGYSNFHYYVMDYWGQGTSVTVSSDLEPKS
SDKTHTSPPSPAPELLGGSSVFLFPPKPKDTLMISRTPEVTCVVVDVSHEDPEVKFN
WYVDGVEVHNAKTKPREEQYNSTYRVVSVLTVLHQDWLNGKEYKCKVSNKALP
APIEKTISKAKGQPREPQVYTLPPSRDELTKNQVSLTCLVKGFYPSDIAVEWESNGQ
PENNYKTTPPVLDSDGSFFLYSKLTVDKSRWQQGNVFSCSVMEALHNHYTQKSL
SLSPGKADPSNPFLVLLHSVSSSLSSSELTELKFLCLGRVGKRKLERVQSGLDLFSM
LLEQNDLEPGHTELLRELLASLRRHDLLRRVDDFEAGAAAGAAPGEEDLCAAFNV
ICDNVGKDWRRLARQLKVSDTKIDSIEDRYPRNLTERVRESLRIWKNTEKENATV
AHLVGALRSCQMNLVADLVQEVQQARDLQNRSGAMSPMSWNSDASTSEAS 130.1D8 scFv hIgG1 (SSS-P)H WCH2 WCH3-hCD80TM/CT
Nucleotide sequence (SEQ ID NO: 481)
```
aagcttatggattttcaagtgcagattttcagcttcctgctaatcagtgcttcagtcataatgtccagaggagtcgacattgtgctcaccc
aatctccagcttctttggctgtgtctctaggtcagagagccaccatctcctgcagagccagtgaaagtgttgaatattatgtcacaagtt
taatgcagtggtaccaacagaaaccaggacagccaccccaaactcctcatctctgctgcatccaacgtagaatctggggtccctgcc
aggtttagtggcagtgggtctgggacagacttcagcctcaacatccatcctgtggaggaggatgatattgcaatgtattctgtcagc
cactcagtctccaacaaccatagctgcatctccaggggagaaggtcaccatcacctgccgtgccagctccagtgtaagttacatgta
ctggtaccagcagcagaagtcaggcgcctcccctaaactctggatttatgacacatccaagctggcttctggagttccaaatcgcttcagt
ggcagtgggtctgggacctcttattctctcgcaatcaacacccatggagactgaagatgctgccacttattactgtcagcagtggagta
gtactccgctcacgttcgggtctggaccaagctggagatcaaacggggtggcggttggctcggcggtggtgggtcgggtggc
ggcggatctcaggtgcagctgaaggaggcaggaccctggcctgtcaacgacacagacctgtcctcacatgcactgtctct
gggttctcattaaccagcgatggtacactggattcgcagcctccaggaaagggtctggaatggatggaataatatattatgat
ggaggcacagattataattcagcaattaaatccagactgagcatcagcagggacacctccaagagccaagttttcttaaaaatcaac
agtctgcaaactgatgacacagccatgtattactgtgccagaatccactttgattactggggccaaggagtcatggtcacagtctcct
ctgatctggagcccaaatcttctgacaaaactcacacatccccaccgtcccccagcacctgaactcctgggggaccgtcagtcttc
ctcttccccccaaaacccaaggacaccctcatgatctcccggaccccgaggtcacatgcgtggtggtggacgtgagccacgaag
accctgaggtcaagttcaactggtacgtggacggcgtggaggtgcataatgccaagacaaagccgcgggaggagcagtacaac
agcacgtaccgtgtggtcagcgtcctcaccgtcctgcaccaggactggctgaatggcaaggagtacaagtgcaaggtctccaaca
aagccctcccagccccatcgagaaaaccatctccaaagccaaagggcagccccgagaaccacaggtgtacaccctgcccccat
cccgggatgagctgaccaagaaccaggtcagcctgacctgcctggtcaaaggcttctatcccagcgacatcgccgtggagtgg
gagagcaatgggcagccggagaacaactacaagaccacgcctcccgtgctggactccgacggctccttcttcctctacagcaag
ctcaccgtggacaagagcaggtggcagcaggggaacgtcttctcatgctccgtgatgcatgaggctctgcacaaccactacacgc
agaagagcctctccctgtctccgggaaagcggatccttcgaacctgctcccatcctgggccattccttaatctcagtaaatggaat
ttttgtgatatgctgcctgacctactgctttgccccaagatgcagagagagaaggaggaatgagagattgagaagggaaagtgtac
gccctgtataaatcgat
```
Amino acid sequence (SEQ ID NO: 482):
MDFQVQIFSFLLISASVIMSRGVDIVLTQSPASLAVSLGQRATISCRASESVEYYVTS
LMQWYQQKPGQPPKLLISAASNVESGVPARFSGSGSGTDFSLNIHPVEEDDIAMYF
CQQSKLMDFQVQIFSFLLISASVIMSRGVDIVLTQSPTTIAASPGEKVTITCRASSSVS
YMYWYQQKSGASPKLWIYDTSKLASGVPNRFSGSGSTSYSLAINTMETEDAATY
YCQQWSSTPLTFGSGTKLEIKRGGGGSGGGGSGGGGSQVQLKEAGPGLVQPTQTL
SLTCTVSGFSLTSDGVHWIRQPPGKGLEWMGIIYYDGGTDYNSAIKSRLSISRDTSK
SQVFLKINSLQTDDTAMYYCARIHFDYWGQGVMVTVSSDLEPKSSDKTHTSPPSP
APELLGGPSVFLFPPKPKDTLMISRTPEVTCVVVDVSHEDPEVKYNWYVDGVEVH
NAKTKPREEQYNSTYRVVSVLTVLHQDWLNGKEYKCKVSNKALPAPIEKTISKAK
GQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGKADPS
NLLPSWAITLISVNGIFVICCLTYCFAPRCRERRRNERLRRESVRPV 131.1D8 scFv mIgAT4-hCD80TM/CT
Nucleotide sequence (SEQ ID NO: 483)
```
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
```

-continued accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcgggtctgggaccaagctggagatcaaacggggtggcggtggctcggggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatc
acatctgttctcctcctactactcctcctccaccttcctgccagcccagcctgtcactgcagcggccagctcttgaggacctgctcctg
ggttcagatgccagcatcacatgtactctgaatggcctgagagacctgagggagctgtcttcacctgggagccctccactgggaa
ggatgcagtgcagaagaaagctgtgcagaattcctgcggctgctacagtgtgtccagcgtcctgcctggctgtgctgagcgctgg
aacagtggcgcatcattcaagtgcacagttacccatcctgagtctgacaccttaactggcacaattgccaaagtcacagtgaacacc
ttcccacccaggtccacctgctaccgcgccgtcggaggagctggccctgaatgagctcgtgtccctgacatgcctggtgcgag
ctttcaaccctaaagaagtgctggtgcgatggctgcatgaaatgaggagctgtccccagaaagctacctagtgtttgagccctaa
aggagccaggcgagggagccaccacctacctggtgacaagcgtgttgcgtgtatcagctgaaatctggaaacagggtgaccagt
actcctgcatggtgggccacgaggccttgcccatgaacttcacccagaagaccatcgaccgtctgtcgggtaaacccaccaatgtc
agcgtgctgtgatcatgtcagagggagaggatccttcgaacaacctgctcccatcctgggccattaccttaatctcagtaaatggaa
ttttttgtgatatgctgcctgacctactgctttgccccaagatgcagagagagaaggaggaatgagagaagggaaagtgtac
gccctgtataaatcgatact Amino acid sequence (SEQ ID NO: 484):
MDFQVQIFSFLLISASVIMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDHICSPPTTPPPPSCQPSLSLQRP
ALEDLLLGSDASITCTLNGLRDPEGAVFTWEPSTGKDAVQKKAVQNSCGCYSVSS
VLPGCAERWNSGASFKCTVTHPESDTLTGTIAKVTVNTFPPQVHLLPPPSEELALN
ELVSLTCLVRAFNPKEVLVRWLHGNEELSPESYLVFEPLKEPGEGATTYLVTSVLR
VSAEIWKQGDQYSCMVGHEALPMNFTQKTIDRLSGKPTNVSVSVIMSEGEDPSNN
LLPSWAITLISVNGIFVICCLTYCFAPRCRERRRNERLRRESVRPV 132.1D8 scFv hIgG1 (SSS-P)H WCH2 WCH3-mFADD-TM/CT
Nucleotide sequence (SEQ ID NO: 485):
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcgggtctgggaccaagctggagatcaaacggggtggcggtggctcggggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatc
ggagcccaaatcttctgacaaaactcacacatccccaccgtcccagcacctgaactcctgggtggaccgtcagtcttcctcttccc
cccaaaacccaaggacaccctcatgatctcccggacccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccaaaacccaaggacaccctcatgatctcccggacccctgaggtcacatgcgtggtggtggacgtgagccacgaagaccctga
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatgaccattcctgctgctgcactcgctgtccggcagcctgtcggg
caacgatctgatggagctcaagttcttgtgccgcgagcgcgtgagcaaacgaaagctggagcgcgtgcagagtggcctggacct
gttcacggtgctgctggagcagaacgacctggagcgcgggcacaccgggctgctgcgcgagttgctggcctcgctcgccgac
acgatctactgcagcgcctggacgacttcgaggcggggacggcgaccgctgcgccccggggaggcagatctgcaggtggc
atttgacattgtgtgacaagtgggagagactggaaaagactgagcgtgactggaggccaagatggatgggg
attgaggagaagtaccccgaagtctgagtgagcgggtaagggagagtctgaaagtctggaagaatgctgagaagaagaacgc
ctcggtggccggactggtcaaggcgctgcggacctgcaggctgaatctggtggctgacctggtgaagaagcccaggaatctgt
gagcaagagtgagaatatgtccccagtactaagggattcaactgtgtcttcctcagaaacaccctgactcgagatcgat Amino acid sequence (SEQ ID NO: 486):
MDFQVQIFSFLLISASVIMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GPSVFLFPPKPKDTLMISRTPEVTCVVVDVSHEDPEVKFNWYVDGVEVHNAKTKP
REEQYNSTYRVVSVLTVLHQDQLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMDPFL
VLLHSLSGSLSGNDLMELKFLCRERVSKRKLERVQSGLDLFTVLLEQNDLERGHT
GLLRELLASLRLLQRLDDFEAGTATAAPPGEADLQVAFDIVCDNVGRDWKR
LARELKVSEAKMDGIEEKYPRSLSERVRESLKVWKNAEKKNASVAGLVKALRTC
RLNLVADLVEEAQESVSKSENMSPVLRDSTVSSSETP 133.1D8 scFv hIgG1 (SSS-P)H P238S CH2 WCH3-mFADD-TM/CT
Nucleotide sequence (SEQ ID NO: 487):
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcncagtggca
gtgggtctgggacctcttattctctcgcaatcaacaccatggagactgaagatgctgccacttattactgtcagcagtggagtagtact -continued

```
ccgctcacgttcgggtctgggaccaagctggagatcaaacggggtggcggtggctcgggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaataatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggatcgtcagtcttcctcttccc
cccaaaacccaaggacaccctcatgatctcccggacccctgaggtcacatgcgtggtggtggacgtgagccacgtgaccctga
ggtcaagttcaactggtacgtggacggcgtggaggtgcataatgccaagacaaagccgcgggaggagcagtacaacagcacgt
accgtgtggtgtcagcgtcctcaccgtcctgcaccaggactggctgaatggcaaggagtacaagtgcaaggtctccaacaaagccct
cccagccccatcgagaaaaccatctccaaagccaaaggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccgttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatggaccccancctggtgctgctgcactcgctcgtccggcagcctgtcggg
caacgatctgatggagctcaagttcttgtgccgcgagcgcgtgagcaaacgaaagctggagcgcgtgcagagtggcctggacct
gttcacggtgctgctggagcagaacgacctggagcgcgggcacaccgggctgctgcgcgagttgctggcctcgctgcgccgac
acgatctactgcagcgcctggacgacttcgaggcgggacggcgaccgctgcgcccccgggggaggcagatctgcaggtggc
atttgacattgtgtgtgacaatgtggggagagactggaaaagactggcccgcgagctgaagtgtctgaggccaagatggatggg
attgaggagaagtaccccgaagtctgagtgagcgggtaagggagagtctgaaagtctgaagaatgctgagaagaagaacgc
ctcggtggccggactggtcaaggcgctgcggacctgcaggctgaatctggtggctgacctggtgaagaagcccaggaatctgt
gagcaagagtgagaatatgtccccagtactaagggattcaactgtgtcttcctcagaaacaccctgactcgagatcgat
```

Amino acid sequence (SEQ ID NO: 488):
MDFQVQIFSFLLISASVIMSRGVDIYLTQSPTTIAASPGEKVTITCRASSSVSYMYWY
QQKSGASPKLWYDTSKLASGVPNRFSGSGSGTSYSLAINTMETEDAATYYCQQW
SSTPLTFGSGTKLETKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GSSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMDPFL
VLLHSLSGSLSGNDLMELKFLCRERVSKRKLERVQSGLDLFTVLLEQNDLERGHT
GLLRELLASLRRRHDLLQRLDDFEAGTATAAPPGEADLQVAFDIVCDNVGRDWKR
LARELKVSEAKMDGIEEKYPRSLSERVRESLKVWKNAEKKNASVAGLVKALRTC
RLNLVADLVEEAQESVSKSENMSPVLRDSTVSSSETP 134.1D8 scFv hIgG1 (SSS-P)H WCH2 WCH3-mcasp3-TM/CT
Nucleotide sequence (SEQ ID NO: 489):
```
aagcttatggatttttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctccctaaactctggatttatgacacatccaagctggcttctggagttctggagttccaaatcgcttcagtggca
gtgggtctgggacctcttattctctcgcaatcaacaccatgagactgaagatgctgccacttattactgtcagcagtggagtagtact
ccgctcacgttcgggtctgggaccaagctggagatcaaacggggtggcggtggctcgggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaataatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggaccgtcagtcttcctcttccc
cccaaaacccaaggacaccctcatgatctcccggacccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagccccatcgagaaaaccatctccaaagccaaaggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatggagaacaacaaaacctcagtggattcaaaatccattaataattttgaa
gtaaagaccatacatggagcaagtcagtggactctgggatctatctggacagtagttacaaaatggattatcctgaaatgggcata
tgcataataattaataataagaacttccataagagcactgaaatgtcatctcgctcgtgatacggatgtggacgcagccaacctcagag
agacattcatgggcctgaaataccaagtcaggaataaaaatgatcttactcgtgaagacattttggaattaatggatagtgtttctaag
gaagatcatagcaaaaggagcagctttgtgtgtgattctaagccatgtgatgaaggggtcatttatgggacaaatggcctgtt
gaactgaaaagttgactagcttcttcagaggcgactactgccggagtctgactggaaagccgaaactcttcatcattcaggcctgc
cggggtacggagctggactgtgcattgagacagacagtggagatggcttgccagaagatacggtggaggc
tgacttcctgtatgcttactctacagcacctggttactattcctggagaaattcaaaggacgggtcgtggttcatccagtcccttgcag
catgctgaagctgtacgcgcacaagctagaatttatgcacattctcactcgcgttaacaggaaggtggcaacggaattcgagtcctt
ctccctggactccactttccacgcaaagaaacagatcccgtgtattgtgtccatgctcacgaaagaactgtacttttatcactagctcg
agatcgatg
```

Amino acid sequence (SEQ ID NO: 490):
MDFQVQIFSFLLISASVIMSRGVDIVLTQSPTTIAASPGEKVTITCRASSSVSYMYWY
QQKSGASPKLWIIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYGTDYNSAIKSRLSISRDTSKSQVFLK
INSLQTDDTAMYYCARIHFDYWGQGVMVTVSSDLEPKSSDKTHTSPPSPAPELLG
GPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSPGKADPSNMENN
KTSVDSKSINNFEVKTIHGSKSVDSGIYLDSSYKMDYPEMGICIINNKNFHKSTGM
SSRSGTDVDAANLRETFMGLKYQVRNKNDLTREDILELMDSVSKEDHSKRSSFVC

```
VILSHGDEGVIYGTNGPVELKKLTSFFRGDYCRSLTGKPKLFIIQACRGTELDCGIET
DSGTDEEMACQKIPVEADFLYAYSTAPGYYSWRNSKDGSWFIQSLCSMLKLYAH
KLEFMHILTRVNRKVATEFESFSLDSTFHAKKQIPCIVSMLTKELYFYH
```

135. 1D8 scFv hIgG1 (SSS-P)H P238S WCH3-mcasp3-TM/CT
Nucleotide sequence (SEQ ID NO: 491):
```
Aagcttatggattttcaagtgcagattttcagcttcctgctaatcagtgcttcagtcataatgtccagaggagtcgacattgtgctcact
cagtctccaacaaccatagctgcatctccaggggagaaggtcaccatcacctgccgtgccagctccagtgtaagttacatgtactg
gtaccagcagaagtcaggcgcctcccctaaactctggatttatgaccacatccaagctggcttctggagttccaaatcgcttcagtgg
cagtgggtctgggaccttattctctcgcaatcaacaccatggagactgaagatgctgccacttattactgtcagcagtggagtagt
actccgctcacgttcggtctgggaccaagctggagatcaaacggggtggcggtggctcggggcggtggtgggtcggtggcgg
cggatctcaggtgcagctgaaggaggcaggacctggcctggtgcaaccgacacagaccctgtccctcacatgcactgtctctgg
gttctcattaaccagcgatggtgtacactggattcgacagcctccaggaaagggtctggaatggatgggaataatatattatgatgga
ggcacagattataattcagcaatttaaatccagactgagcatcagcagggacacctccaagagccaagttttcttaaaaatcaacagt
ctgcaaactgatgacacagccatgtattactgtgccagaatccactttgattactggggccaaggagtcatggtcacagtctcctctg
a
```

Amino acid sequence (SEQ ID NO: 492):
```
MDFQVQIFSFLLISASVIMSRGVDIVLTTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GSSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNSNME
NNKTSVDSKSINNFEVKTIHGSKSVDSGIYLDSSYKMDYTPEMGICIIINNKNFHKST
GMSSRSGTDVDAANLRETFMGLKYQVRNKNDLTREDILELMDSVSKEDHSKRSSF
VCVIILSHGDEGVIYGTNGPVELKKLTSFFRGDYCRSLTGKPKLFIIQACRGTELDCG
IETDSGTDEEMACQKIPVEADFLYAYSTAPGYYSWRNSKDGSWFIQSLCSMLKLY
AHKLEFMHILTRVNRKVATEFESFSLDSTFHAKKQIPCIVSMLTKELYFYH
```

136. 1D8 scFv hIgG1 (SSS-P)H WCH2 WCH3-mcasp8-TM/CT
Nucleotide sequence (SEQ ID NO: 493):
```
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggaccttattctctcgcaatcaacaccatggagactgaagatgctgccacttattactgtcagcagtggagtagtact
ccgctcacgttcggtctgggaccaagctggagatcaaacggggtggcggtggctcggggcggtggtgggtcggtggcggcg
gatctcaggtgcagctgaaggaggcaggacctggcctggtgcaaccgacacagaccctgtccctcacatgcactgtctctggtt
ctcattaaccagcgatggtgtacactggattcgacagcctccaggaaagggtctggaatggatgggaataatatattatgatggagg
cacagattataattcagcaatttaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggaccgtcagtcttcctcttccc
cccaaaacccaaggacacctcatgatctcccggaccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagcccccatcgagaaaaccatctccaaagccaaagggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatggatttccagagttgtctttatgctattgctgaagaactgggcagtgaag
acctggctgccctcaagttcctgtgcttggactacatcccacacaagaagcaggagaccatcgaggatgcccagaagctatttctg
aggctgcgggaaaagggatgttgaggaaggcaatctgtctttcctggaagaccttcctcacatcagtcggtgggactgct
ggtcaacttcctagactgcaaccgagaggagatggtgagagagctgcgggatccagacaatgcccagattctccctacagggtc
atgctctttaagctctcagaagaagtgagcgagttggaattgagatcttttaagttccttttgaacaatgagatcccaaatgtaagctg
gaagatgacttgagcctgcttgaaattttttgtagaaatggagaagaggaccatgctggcagaaaataacttggaaaccctaaaatca
atctgtgaccaggtcaacaagagcctgctggggaagatcgaggattacaagaataacaagacaagagaagaataagccttgaa
gtgagtcacggacttcagacaaagtttaccaaatgaagaacaaacctcggggatactgtctgatcatcaacaatcatgatttcagca
aggcccgggaagacataacccaactccgaaaaatgaaggacagaaaaggaacagactgtgataaagaggctctgagtaagacc
tttaaggagcttcattttgagatagtatcttacgacgactgcactgcaaatgaaatccacgagattctagaaggctaccaaagcgcag
accacaagaacaaagactgcttcatctgctgtatcctatcccacggtgacaagggtgtcgtatggaacggatgggaaggaggc
ctccatctatgacctgacatcttacttcactggttcaaagtgccttcccctgtctgggaaacccaagatcttttttcattcaggcttgccaa
ggagtaacttccagaaaggagtgcctgatgaggcaggcttcgacaacagaaccacactttagaagtggattcatcatctcacaa
gaactatattccggatgaggcagacttctgctgggaatggctacggtgaagaactgcgtttcctaccgagatcctgtgaatggaac
ctggtatattcagtcactttgccagagcctgagggaaagatgtcctcaaggagatgacattcttagcatcctgactggcgtgaactat
gacgtgagcaataaagacgacgaggagaacaagggaaagcagatgccacagcccaccttcacactacggaagaagctcttcttc
cctccctaatgactcgagatcgatt
```

Amino acid sequence (SEQ ID NO: 494):
```
MDFQVQIFSFLLISASVIMSRGVDIVLTTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMDFQS
```

```
CLYAIAEELGSEDLAALKFLCLDYIPHKKQETIEDAQKLFLRLREKGMLEEGNLSFL
KELLFHISRWDLLVNFLDCNREEMVRELRDPDNAQISPYRVMLFKLSEEVSELELR
SFKFLLNNEIPKCKLEDDLSLLEIFVEMEKRTMLAENNLETLKSICDQVNKSLLGKI
EDYERSSTERRMSLEGREELPPSVLDEMSLKMAELCDSPREQDSESRTSDKVYQM
KNKPRGYCLIINNHDFSKAREDITQLRKMKDRKGTDCDKEALSKTFKELHFEIVSY
DDCTANEIHEILEGYQSADHKNKDCFICCILSHGDKGVVYGTDGKEASIYDLTSYF
TGSKCPSLSGKPKIFFIQACQGSNFQKGVPDEAGFEQQNHTLEVDSSSHKNYIPDEA
DFLLGMATVKNCVSYRDPVNGTWTIQSLCQSLRERCPQGDDILSILTGVNYDVSN
KDDRRNKGKQMPQPTFTLRKKLFFPP 137.1D8 scFv hIgG1 (SSS-P)H P238SCH2 WCH3-mcasp8-TM/CT
Nucleotide sequence (SEQ ID NO: 495):
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttatactgtcagcagtggagtagtact
ccgctcacgttcgggtctgggaccaagctggagatcaaacggggtggcggtggctcgggcggtggtgggtcgggtggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggatcgtcagtcttcctcttccc
cccaaaacccaaggacacccctcatgatctcccggaccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagcccct
cccagcccccatcgagaaaaccatctccaaagccaaagggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcgggatccttcgaacatggatttcagagttgtcttatgctattgctgaagaactgggcagtgaag
aactggctgccctcaagttcctgtgcttggactatacccacacaagaagcaggagaccatcgaggatgcccagaagctatttctg
aggctgcgggaaaaggggattttggaggaaggcaatctgtctttcctgaaagagctgcttttccacatcagtcggtgggacctgct
ggtcaacttcctagactgcaaccgagaggagatggtgagagagctgcgggatccagacaatgcccagatttctccctacagggtc
atgctctttaagctctcagaagaagtgagcgagttggaattgagatcttttaagttccttttgaacaatgagatccccaaatgtaagctg
gaagatgacttgagcctgcttgaaatttttgtagaaatggagaagaggaccatgctggcagaaaataacttggaaaccctaaaatca
atctgtgaccaggtcaacaagagcctgctggggaagatcgaggattatgaaagatcaagcacagagaagaatgagccttgaa
ggaagggaagagttgccaccttcagtggatgagatgagcctcaaaatggcggaactggactcgcaagagaacaagaca
gtgagtcacggacttcagacaaagtttaccaaatgaagaaccaaacctcgggaatacgtctgtcatcaacaatcatgatttcagca
aggcccgggaagacataaacccaactccgaaaaatgaaggacagaaaaggaacagactgtgataaagaggctctgagtaagacc
tttaaggagcttcattttgagatagtatcttacgacgactgcactgcaaatgaaatccacgagattctagaaggctaccaaagcgcag
accacaagaacaaagactgcttcatctgctgtatcctatcccacggtgacaagggtgtcgtctatggaacggatgggaaggaggc
ctccatctatgacctgacatcttacttcactggttcaaagtgccctccctgtctgggaaaacccaagatcttttttcattcaggcttgccaa
ggaagtaacttccagaaagagtgcctgatgaggcaggcttcgagcaacagaacacacttttagagtggattcatcatctcacaa
gaactatattccggatgaggcagactttctgctgggaatggctacggtgaagaactgcgtttcctaccgagatcctgtgaatggaac
ctggtatattcagtcactttgccagagcctgagggaaagatgtcctcaaggagatgacattcttagcatcctgactggcgtgaactat
gacgtgagcaataaagacgacaggaggaacaagggaaagcagatgccacagcccaccttcacactacggaagaagctcttcttc
cctccctaatgactcgagatcgattc Amino acid sequence (SEQ ID NO: 496):
MDFQVQIFSFLLISASVIMSRGVDILVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GSSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMEALHNHYTQKSLSLSPGKADPSNMDFQS
CLYAIAEELGSEDLAALKFLCLDYIPHKKQETIEDAQKLFLRLREKGMLEEGNLSFL
KELLFHISRWDLLVNFLDCNREEMVRELRDPDNAQISPYRVMLFKLSEEVSELELR
SFKFLLNNEIPKCKLEDDLSLLEIFVEMEKRTMLAENNLETLKSICDQVNKSLLGKI
EDYERSSTERRMSLEGREELPPSVLDEMSLKMAELCDSPREQDSESRTSDKVYQM
KNKPRGYCLIINNHDFSKAREDITQLRKMKDRKGTDCDKEALSKTFKELHFEIVSY
DDCTANEIHEILEGYQSADHKNKDCFICCILSHGDKGVVYGTDGKEASIYDLTSYF
TGSKCPSLSGKPKIFFIQACQGSNFQKGVPDEAGFEQQNHTLEVDSSSHKNYIPDEA
DFLLGMATVKNCVSYRDPVNGTWYIQSLCQSLRERCPQGDDILSILTGVNYDVSN
KDDRRNKGKQMPQPTFTLRKKLFFPP 138.1D8 scFv hIgG1 (SSS-P)H WCH2 WCH3-hcasp3-TM/CT (SEQ ID NO: 497)
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcgggctgggaccaagctggagatcaaacggggtggcggtggctcgggcggtggtgggtcggcggcggcg
gatctcaggtgcagctgaaggaggcaggacctggcctggtgcaaccgacacagaccctgtccctcacatgcactgtctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacaacagtctg
caaactgatgacacagccatgtattactgtgccagaatccactttgattactggggccaaggagtcatggtcacagtctcctctgatct
ggagcccaaatcttctgacaaaactcacacatccccaccgtccccagcacctgaactcctgggtggaccgtcagtcttcctcttccc
cccaaaacccaaggacacccctcatgatctcccggaccctgaggtcacatgcgtggtggtggacgtgagccacgtgacccctga
```

-continued

```
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagccccatcgagaaaaccatctccaaagccaaaggcagccccgagaaccacaggtgtacaccctgcccccatcccggg
atgagctgaccaagaaccaggcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggggcagcaggggaacgtcttctcatgctccgtgatgcatgaggctctgcacaaccactacacgcag~gag
cctctccctgtctccgggaagcggatccttcgaacatggagaacactgaaaactcagtggattcaaaatccattaaaaatttggaa
ccaaagatcatacatggaagcgaatcaatggactctggaatatccctggacaacagttataaaatggattatcctgagatgggtttat
gtataataattaataataagaattttcataaaagcactggaatgacatctcggtctggtacagatgtcgatgcagcaaacctcaggga
aacattcagaaacttgaaatatgaagtcaggaataaaaatgatcttacacgtgaagaaatttggaattgatgcgtgatgtttctaaag
aagatcacagcaaaaggagcagttttgtttgtgtgcttctgagccatggtgaagaaggaataattttggaacaaatggacctgttga
cctgaaaaaaataacaaactttttcagaggggatcgttgtagaagtctaactggaaaacccaaacttttcattattcaggcctgccgtg
gtacagaactggactgtggcattgagacagacagtggtgttgatgatgacatggcgtgtcataaaataccagtggaggccgacttct
tgtatgcatactccacagcacctggttattattcttggcgaaatttcaaaggatggctcctggttcatccagtcgctttgtgccatgctga
aacagtatgccgacaagcttgaatttatgcacattcttacccgggttaaccgaaaggtggcaacagaatttgagtcctttttcctttgac
gctacttttcatgcaaagaaacagattccatgtgtattgtttccatgctcacaaaagaactctatttttatcactaactcgagatcgata
```

Amino acid sequence (SEQ ID NO: 498):
MDFQVQIFSFLLISASVIMSRGVDIVLTQSPTTIAASPGEKVTITCRASSSVSYMYWY
QQKSGASPKLWTYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GPSVFLFPPKPKDTLMISRTPEVTCVVVDVSHEDPEVKFNWYVDGVEVNTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMENTE
NSVDSKSIKNLEPKIIHGSESMDSGISLDNSYKMDYPEMGLCIIINNKNFHKSTGMT
SRSGTDVDAANLRETFRNLKYEVRNKNDLTREEIVELMRDVSKEDHSKRSSFVCV
LLSHGEEGIIFGTNGPVDLKKITNFFRGDRCRSLTGKPKLFIIQACRGTELDCGIETD
SGVDDDMACHKIPVEADFLYAYSTAPGYYSWRNSKDGSWFIQSLCAMLKQYADK
LEFMHILTRVNRKVATEFESFSFDATFHAKKQIPCIVSMLTKELYFYH 139.1D8 scFv hIgG1 (SSS-P)H P238SCH2 WCH3-hcasp3-TM/CT
Nucleotide sequence (SEQ ID NO: 499):
```
aagcttatggatttttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggt
accagcagaagtcaggcgcctccccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtact
ccgctcacgttcggctgggaccaagctggagatcaaacggggtggcggtggctcgggcggtggtgggtcgggtggcggcg
gatctcaggtgcagctgaaggaggcaggacctggcctggtgcaaccgacacagaccctgtccctcacatgcactgtctctggtt
ctcattaaccagcgatggtgtcactggattcgacagcctccaggaaagggtctggaattggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaattccactttgattactggggccaaggagtcatgtcacagtctcctctgatct
ggagcccaaatcttctgacaaaactcacacatccccaccgtccccagcacctgaactcctgggtggatcgtcagtcctcctcccc
cccaaaacccaaggacaccctcatgatctcccggacccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagccccatcgagaaaaccatctccaaagccaaaggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaagcggatccttcgaacatggagaacactgaaaactcagtggattcaaaatccattaaaaatttggaa
ccaaagatcatacatggaagcgaatcaatggactctggaatatccctggacaacagttataaaatggattatcctgagatgggtttat
gtataataattaataataagaattttcataaaagcactggaatgacatctcggtctggtacagatgtcgatgcagcaaacctcaggga
aacattcagaaacttgaaatatgaagtcaggaataaaaatgatcttacacgtgaagaaattgtgaattgatgcgtgatgtttctaaag
aagatcacagcaaaaggagcagttttgtttgtgtgcttctgagccatggtgaagaaggaataattttggaacaaatggacctgttga
cctgaaaaaaataacaaactttttcagaggggatcgttgtagaagtctaactggaaaacccaaacttttcattattcaggcctgccgtg
gtacagaactggactgtggcattgagacagacagtggtgttgatgatgacatggcgtgtcataaaataccagtggaggccgacttct
tgtatgcatactccacagcacctggttattattcttggcgaaatttcaaaggatggctcctggttcatccagtcgctttgtgccatgctga
aacagtatgccgacaagcttgaatttatgcacattcttacccgggttaaccgaaaggtggcaacagaatttgagtcctttttcctttgac
gctacttttcatgcaaagaaacagattccatgtgtattgtttccatgctcacaaaagaactctatttttatcactaactcgagatcgataa
```

Amino acid sequence (SEQ ID NO: 500):
MDFQVQIFSFLLISASVIMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GSSVFLFPPKPKDTLMTSRTPEVTCVVVDVSHEDPEVKFNWYVDGVEVHNAKTKY
REEQYNSTYRVVSVLTVLHQDWLNGKEYKCKVSNKALPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMENTE
NSVDSKSIKNLEPKIIHGSESMDSGISLDNSYKMDYPEMGLCIIINNKNFHKSTGMT
SRSGTDVDAANLRETFRNLKYEVRNKNDLTREEIVELMRDVSKEDHSKRSSFVCV
LLSHGEEGIIFGTNGPVDLKKITNFFRGDRCRSLTGKPKLFIIQACRGTELDCGIETD
SGVDDDMACHTKIPVEADFLYAYSTAPGYYSWRNSKDGSWFIQSLCAMLKQYADK
LEFMHILTRVNRKVATEFESFSFDATFHAKKQLPCIVSMLTKELYFYH 140.1D8 scFv hIgG1 (SSS-S)H WCH2 WCH3-hcasp8-TM/CT
Nucleotide sequence (SEQ ID NO: 501):
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggtat
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtctgggaccaagctggagatcaaacgggtggcggtggctcgggcggtggtgggtcgggtggcggcg
gatctcaggtgcagctgaaggaggcaggacctggcctgcaaccgacacagaccctgtccctcacatgcactgtctctctgggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggacgtcagtcttcctcttccc
cccaaaacccaaggacacccatgatctcccggacccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagcccccatcgagaaaaccatctccaaagccaaagggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatggacttcagcagaaatctttatgatattggggaacaactggacagtgaa
gatctggcctcccctcaagttcctgagcctggactacattccgcaaaggaagcaagaacccatcaaggatgccttgatgttattccag
agactccaggaaaagagaatgttggagaaagcaatctgtccttcctgaaggagctgctcttccgaattaatagactggatttgctg
attacctacctaaacactagaaaggaggagatggaaagggaacttcagacaccaggcagggctcaaatttctgcctgacagggtca
tgctctatcagatttcagaagaagtgagcagatcagaattgaggtctttttaagtttcttttgcaagaggaaatctccaaatgcaaactgg
atgatgacatagacctgctggatattttcatagagatggagaaaagggtcatcctgggagaaggaaagttggacatcctgaaaaga
gtctgtgcccaaatcaacaagagcctgctgaagataatcaacgactatgaagaattcagcaagagagaagcagcagccttgaag
gaagtcctgatgaattttcaaatggggaggagttgtgtggggtaatgacaatctcggactctccaagagaacaggatagtgaatcac
agactttggacaaagtttaccaaatgaaaagcaaacctcggggatactgtctgatcatcaacaatcacaattttgcaaaagcacggg
agaaagtgcccaaacttcacagcattagggacgggatgaacacacttgagctgagcacgacgctttgaaggcttt
catttttgagatcaagccccacgatgactgcacagtagagcaaatctatgagattttgaaaatctaccaactcatggaccacagtaaca
tggactgcttcatctgctgtatcctctcccatggagacaagggcatcatctatggcactgatggacaggaggcccccatctatgagct
gacatctcagttcactggtttgaagtgcccttcccttcccttgctggaaaacccaaagtgttttttattcaggcttgtcaggggataactacca
gaaaggtatacctgttgagactgattcagaggagcaacccattagaaatggatttatcatcacctcaacgagatatatcccggat
gaggctgactttctgctggggatggccactgtgaataactgtgtttcctaccgaaaccctgcagagggaacctggtacatccagtca
ctttgccagagcctgagagagcgatgtcctgcaggcgatgatattctcaccatcctgactgaagtgaactatgaagtaagcaacaa
ggatgacaagaaaaacatggggaaacagatgcctcagcctactttcacactaagaaaaaaacttgtcttcccttctgattgagcatg
catcgata Amino acid sequence (SEQ ID NO: 502):
MSFQVQIFSFLLISASVIMSRGVDIVLTQSPTTIAASPGEKVTITCRASSVSYMYWY
QQKSGASPKLWIYDTSKLASQVPNRFSGSGSGTSYSLAINTMETEDAATYYCQQW
SSTPLTFGSGTKLEIKRGGGSGGGGSGGGGSQVQLKEAGPGLVQPTQTLSLTCTV
SGFSLTSDGVHWIRQPPGKGLEWMGIIYYDGGTDYNSAIKSRLSIRDTSKSTSKSQVFLK
INSLQTDDTAMYYCARIHFDYWGQGVMTVSSDLEPKSSDKTHTSPPSPAPELLG
GPSVFLFPPKPKDTLMISRTEVTCVVVDDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLPGKADPSNMDFSR
NLYDIGEQLDSEDLASLKFLSLDYIPQRKQEPIKDALMLFQRLQEKRMLEESNLSFL
KELLFRINRLDLLITYLNTRKEEMERELQTPGRAQISAYRVMLYQISEEVSRSELRS
FKFLLQEEISKCKLDDDMNLLDIFIEMEKRVILGRGKLDILKRVAQINKSLLKIIND
YEEFSKERSSSLEGSPDEFSNGEELCGVMTISDSPREQDSESQTLDKVYQMKSKPR
GYCLIINHNFAKAREKVPKLHSIRDRNGTHLDAGALTTTFEELHFEIKPHDDCTV
EQIYEILKIYQLMDHSNMDCFICCILSHGDKGIIYGTDGQEAPIYELTSQFTGLKCPS
LAGKPKVFFIQACQGDNYQKGIPVETDSEEQPYLEMDLSSPQTRYIPDEDFLLGM
ATVNNCVSYRNPAEGTWYIQSLCQSLRERCPRGDDILTILTEVSNKDDKKN
MGKQMPQPTFTLRKKLVFPSD 141.1D8 scFv hIgG1 (SSS-S)H P238SCH2 WCH3-hcasp8-TM/CT
Nucleotide sequence (SEQ ID NO: 503):
aagcttatggattttcaagtgcagattttcagcttcctgctaatcagtgcttcagtcataatgtccagaggagtcgacattgtgctcactc
agtctccaacaaccatagctgcatctccaggggagaaggtcaccatcacctgccgtgccagctccagtgtaagttacatgtactggtat
accagcagaagtcaggcgcctcccctaaactctggatttatgacacatccaagctggcttctggagttccaaatcgcttcagtggca
gtgggtctgggacctcttattctctcgcaatcaacaccatggagactgaagatgctgccacttattactgtcagcagtggagtagtact
ccgctcacgttcggtctgggaccaagctggagatcaaacgggtggcggtggctcgggcggtggtgggtcgggtcgggtggcggcg
gatctcaggtgcagctgaaggaggcaggacctggcctgcaaccgacacagaccctgtccctcacatgcactgtctctctggtt
ctcattaaccagcgatggtgtacactggattcgacagcctccaggaaagggtctggaatggatgggaataatatattatgatggagg
cacagattataattcagcaattaaatccagactgagcatcagcagggacacctccaagagccaagttttcttaaaaatcaacagtctg
caaactgatgacacagccatgtattactgtgccagaatccactttgattactggggccaaggagtcatggtcacagtctcctctgatct
ggagcccaaatcttctgacaaaactcacacatccccaccgtcccagcacctgaactcctgggtggatcgtcagtcttcctcttccc
cccaaaacccaaggacacccctcatgatctcccggacccctgaggtcacatgcgtggtggtggacgtgagccacgaagaccctga
ggtcaagttcaactggtacgtggacggcgtggaggtgcataatgccaagacaaagccgcgggaggagcagtacaacagcacgt
accgtgtggtcagcgtcctcaccgtcctgcaccaggactggctgaatggcaaggagtacaagtgcaaggtctccaacaaagccct
cccagcccccatcgagaaaaccatctccaaagccaaagggcagccccgagaaccacaggtgtacaccctgcccccatcccggg
atgagctgaccaagaaccaggtcagcctgacctgcctggtcaaaggcttctatcccagcgacatcgccgtggagtgggagagca
atgggcagccggagaacaactacaagaccacgcctcccgtgctggactccgacggctccttcttcctctacagcaagctcaccgt
ggacaagagcaggtggcagcaggggaacgtcttctcatgctccgtgatgcatgaggctctgcacaaccactacacgcagaagag
cctctccctgtctccgggtaaagcggatccttcgaacatggacttcagcagaaatctttatgatattggggaacaactggacagtgaa
gatctggcctcccctcaagttcctgagcctggactacattccgcaaaggaagcaagaacccatcaaggatgccttgatgttattccag -continued agactccaggaaaagagaatgttggaggaaagcaatctgtccttcctcttccgaattaatagactggatttgctg
attacctacctaaacactagaaaggaggagatggaaagggaacttcagacaccaggcagggctcaaatttctgcctacagggtca
tgctctatcagatttcagaagaagtgagcagatcagaattgaggtctctttaagtttcttttgcaagaggaaatctccaaatgcaaactgg
atgatgacatgaacctgctggatattttcatagagatggagaagagggtcatcctgggagaaggaaagttggacatcctgaaaaga
gtctgtgcccaaatcaacaagagcctgctgaagataatcaacgactatgaagaattcagcaaagagagaagcagcagccttgaag
gaagtcctgatgaattttcaaatgggaggagttgtgtggggtaatgacaatctcggactctccaagagaacaggatagtgaatcac
agactttggacaaagtttaccaaatgaaaagcaaacctcggggatactgtctgatcatcaacaatcacaattttgcaaaagcacggg
agaaaggcccaaacttcacagcattagggacaggaatggaacacacttggatgcaggggctttgaccacgacctttgaagagctt
cattttgagatcaagccccacgatgactgcacagtagagcaaaatctatgagattttgaaaatctaccaactcatggaccacagtaaca
tggactgcttcatctgctgtatcctctcccatggagacaaggcatcatctatggcactgatggacaggaggcccccatctatgagct
gacatctcagttcactggtttgaagtgcccttcccttgctgaaaacccaaagtgttttttattcaggcttgtcaggggataactacca
gaaaggtatacctgttgagactgattcagaggagcaaccctatttagaaatggatttatcatcacctcaacgacgagatatatcccggat
gaggctgactttctgctggggatggccactgtgaataactgtgtttcctaccgaaaccctgcagagggaacctggtcatccagtca
ctttgccagagcctgagagagcgatgtcctcgaggcgatgatattctcaccatcctgactgaagtgaactatgaagtaagcaacaa
ggatgacaagaaaaacatggggaaacagatgcctcagcctactttcacactaagaaaaaaacttgtcttcccttctgattgagcatg
catcgataa Amino acid sequence (SEQ ID NO: 504):
MDFQVQIFSFLLISASVIMSRGVDIVLTQSPTTIAASPGEKVTITCRASSSVSYMYWY
QQKSGASPKLWIYDTSKLASGVPNRFSGSGSGTSYSLAINTMETEDAATYYCQQW
SSTPLTFGSGTKLEIKRGGGGSGGGGSGGGGSQVQLKEAGPGLVQPTQTLSLTCTV
SGFSLTSDGVHWIRQPPGKGLEWMGIIYYDGGTDYNSAIKSRLSISRDTSKSQVFLK
INSLQTDDTAMYYCARIHFDYWGQGVMVTVSSDLEPKSSDKTHTSPPSPAPELLG
GSSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREP
QVYTLPPSRDELTKNQVSLTCLVKGFYPSDIAVEWESNGQPENNYKTTPPVLDSDG
SFFLYSKLTVDKSRWQQGNVFSCSVMHEALHNHYTQKSLSLSPGKADPSNMDFSR
NLYDIGEQLDSEDLASLKFLSLDYIPQRKQEPIKDALMLFQRLQEKRMLEESNLSFL
KELLFRINRLDLLITYLNTRKEEMERELQTPGRAQISAYRVMLYQISEEVSRSELRS
FKFLLQEEISKCKLDDDMNLLDIFIEMEKRVILGEGKIDILKRVCAQINKSLLKIIND
YEEFSKERSSSLEGSPDEFSNGEELCGVMTISDSPREQDSESQTLDKVYQMKSKPR
GYCLIINHNFAKAREKVPKLHSIRDRNGTHLDAGALTTTFEELHFEIKPHDDCTV
EQIYEIILKIYQLMDHSNMDCFICCILSHGDKGIIYGTDGQEAPIYELTSQFTGLKCPS
LAGKPKVFFIQACQGDNYQKGIPVETDSEEQPYLEMDLSSPQTRYIPDEADFLLGM
ATVNNCVSYRNPAEGTWYIQSLCQSLRERCPRGDDILTILTEVNYEVSNKDDKKN
MGKQMPQPTFTLRKKLVFPSD 145. HCTLA4 IgAH IgACH2CH3
Nucleotide sequence (SEQ ID NO: 505):
atggcttgccttggatttcagcggcacaaggctcagctgaacctggctgccaggacctggccctgcactctcctgttttttcttctcTTc
atccctgtcttctgcaaagcaatgcacgtggcccagcctgctgtggtactggccagcagccgaggcatcgccagctttgtgtgtga
gtatgcatctccaggcaaagccactgaggtccggtgacagtgcttcggcaggctgacagccaggtgactgaagtctgtgcggc
aacctacatgacggggaatgagttgaccttcctagatgattccatctgcacgggcacctccagtggaaatcaagtgaacctcactat
ccaaggactgagggccatggacacgggactctacatctgcaaggtggagctcatgtacccaccgccatactacctgggcataggg
caacggaacccagatttatgtaattgatccagaaccgtgcccagattctgatcagccagttccctcaactccacctaccccatctccc
tcaactccacctaccccatctccctcatgctgccaccccgactgtcactgcaccgaccggcctcgaggacctgctcttaggttca
gaagcgatcctcacgtgcacactgaccggcctgagagatgcctcaggtgtcaccttcacctggacgccctcaagtgggaagagc
gctgttcaaggaccacctgaccgtgacctctgtggctgctacagcgtgtccagtgtcctgccgggctgtgccgagccatggaacca
tgggaagaccttcacttgcactgctgcctaccccgagtccaagacccgctaaccgccaccctctcaaaatccggaaacacattcc
ggcccgaggtccacctgctgccgccgcgtcggaggagctggccctgaacgagctggtgacgctgacgtgcctggcacgtggc
ttcagccccaaggatgtgctggttcgctggctgcaggggtcacaggagctgccccgcgagaagtacctgacttgggcatcccgg
caggagcccagccagggcaccaccaccttcgctgtgaccagcatactgcgcgtggcagccgaggactggaagaagggggaca
ccttctcctgcatggtgggccacgaggccctgccgctggccttcacacagaagaccatcgaccgcttggcgggtaaacccaccca
tgtcaatgtgtctgttgtcatggcggaggtggacggcacctgctactgataatctaga Amino acid sequence (SEQ ID NO: 506):
MACLGFQRHKAQLNLAARTWPCTLLFFLLFIPVFCKAMHVAQPAVVYLASSRGIAS
FVCEYASPGKATEVRVTVLRQADSQVTEVCAATYMTGNELTFLDDSICTGTSSGN
QVNLTIQGLRAMDTGLYICKVELMYPPPYYLGIGNGTQIYVIDPEPCPDSDQPVPST
PPTPSPSTPPTPSPSCCHPRLSLHRPALEDLLLGSEAILTCTLTGLRDASGVTFTWTPS
SGKSAVQGPPDRDLCGCYSVSSVLPGCALEPWNHGKTFTCTAAYPESKTPLTATLS
KSGNTFRPEVHLLPPPSEELALNELVTLTCLARGFSPKDVLVRWLQGSQELPREKY
LTWASRQEPSQGTTTFAVTSILRVAAEDWKKGDTFSGMVGHEALPLAFTQKTIDR
LAGKPTHVNVSVVMAEVDGTCY 146. hCTLA4 IgA WH WCH2 T4CH3 (hCTLA4 IgAH IgACH2CH3)
Nucleotide sequence (SEQ ID NO: 507):
atggcttgccttggatttcagcggcacaaggctcagctgaacctggctgccaggacctggccctgcactctcctgttttttcttctcttc
atccctgtcttctgcaaagcaatgcacgtggcccagcctgctgtggtactggccagcagccgaggcatcgccagctttgtgtgtga
gtatgcatctccaggcaaagccactgaggtccggtgacagtgcttcggcaggctgacagccaggtgactgaagtctgtgcggc
aacctacatgacggggaatgagttgaccttcctagatgattccatctgcacgggcacctccagtggaaatcaagtgaacctcactat
ccaaggactgagggccatggacacgggactctacatctgcaaggtggagctcatgtacccaccgccatactacctgggcataggg
caacggaacccagatttatgtaattgatccagaaccgtgcccagattctgatcagccagttccctcaactccacctaccccatctccc
tcaactccacctaccccatctccctcatgctgccaccccgactgtcactgcaccgaccggcctcgaggacctgctcttaggttca
gaagcgatcctcacgtgcacactgaccggcctgagagatgcctcaggtgtcaccttcacctggacgccctcaagtgggaagagc
gctgttcaaggaccacctgaccgtgacctctgtggctgctacagcgtgtccagtgtcctgccgggctgtgccgagccatggaacca
tgggaagaccttcacttgcactgctgcctaccccgagtccaagacccgctaaccgccaccctctcaaaatccggaaacacattcc
ggcccgaggtccacctgctgccgccgcgtcggaggagctggccctgaacgagctggtgacgctgacgtgcctggcacgtggc
ttcagccccaaggatgtgctggttcgctggctgcaggggtcacaggagctgccccgcgagaagtacctgacttgggcatcccgg
caggagcccagccagggcaccaccaccttcgctgtgaccagcatactgcgcgtggcagccgaggactggaagaagggggaca -continued ccttctcctgcatggtgggccacgaggccctgccgctggccttcacacagaagaccatcgaccgcttggcgggtaaacccaccca
tgtcaatgtgtctgttgtcatggcggaggtggactgataatctaga Amino acid sequence (SEQ ID NO: 508):
MACLGFQRHKAQLNLAARTWPCTLLFFLLFIPVFCKAMHVAQPAVVTLASSRGIAS
FVCEYASPGKATEVRVTVLRQADSQVTEVCAATYMTGNELTFLDDSICTGTSSGN
QVNLTIQGLRMADTGLYICKVELMYPPPYYLGIGNGTQIYVIDPEPCPDSDQPVPST
PPTPSPSTPPTPSPSCCHPRLSLHRPALEDLLLGSEAILTCTLTGLRDASGVTFTWTPS
SGKSAVQGPPDRDLCGCYSVSSVLPGCAEPWNHGKTFTCTAAYPESKTPLTATLS
KSGNTFRPEVHLLPPPSEELALNELVTLTCLARGFSPKDVLVRWLQGSQELPREKY
LTWASRQEPSQGTTTFAVTSILRVAAEDWKKGDTFSCMVGHEALPLAFTQKTIDR
LAGKPTHVNVSVVMAEVD 147. hIGA WH WCH2 T18CH3
Nucleotide sequence (SEQ ID NO: 509):
Tgatcagccagttccctcaactccacctaccccatctccctcaactccacctaccccatctccctcatgctgccacccccgactgtca
ctgcaccgaccggcctcgaggacctgctcttaggttcagaagcgatcctcacgtgcacactgaccggcctgagagatgcctcag
gtgtcaccttcacctggacgccctcaagtgggaagagcgctgttcaaggaccacctgacctgaccgtgacctctgtggctgctacagcgtg
tccagtgtcctgccgggctgtgccgagccatggaaccatgggaagaccttcacttgcactgctgcctaccccgagtccaagaccc
cgctaaccgccacctctcaaaatccggaaacacattccggcccgaggtccacctgctgccgccgccgtcggaggagctggccc
tgaacgagctggtgacgctgacgtgcctggcacgtggcttcagccccaaggatgtgctggttcgctggctgcaggggtcacagg
agctgccccgcgagaagtacctgacttgggcatcccggcaggagcccagccagggcaccaccaccttcgctgtgaccagcata
ctgcgcgtggcagccgaggactggaagaaggggacaccttctcctgcatggtgggccacgaggccctgccgctggccttcac
acagaagaccatcgaccgcttggcgggtaaatgataatctaga Amino acid sequence (SEQ ID NO: 510):
DQPVPSTPPTPSPSTPPTPSPSCCHPRLSLHRPALEDLLLGSEAILTCTLTGLRDASGV
TFTWTPSSGKSAVQGPPDRDLCGCYSVSSVLPGCAEPWNHGKTFTCTAAYPESKT
PLTATLSKSGNTFRPEVHLLPPPSEELALNELVTLTCLARGFSPKDVLVRWLQGSQ
ELPREKYLTWASRQEPSQGTTTFAVTSILRVAAEDWKKGDTFSCMVGHEALPLAF
TQKTIDRLAGK 150. G19-4 scFv (SSS-P)WH WCH2 WCH3-hCD80TMCT
Nucleotide sequence (SEQ ID NO: 511):
aagcttatggattttcaagtgcagattttcagcttcctgctaatcagtgcttcagtcataatgtccagaggagtcgacatccagatgaca
cagactacatcctccctgtctgcctctctgggagacagagtcaccatcagttgcagggcaagtcaggacattcgcaattatttaaact
ggtatcagcagaaaccagatggaactgttaaactcctgatctactacacatcaagattacactcaggagtcccatcaaggttcagtg
gcagtgggtctggaacagattattctctcaccattgccaacctgcaacctgaagatattgccacttacttttgccaacagggtaatac
gcttccgtggacgttcggtggaggcaccaaactggtaaccaaacgggagctcggtggcggttcgggcggtggtggttcgggcgg
gtggcggcggatctatcgatgaggtccagctgcaacagtctggacctgaactggtgaagcctggagcttcaatgtcctgcaaggc
ctcggttactcattcactggctacatcgtgaactggctgaagcagagccatggaaagaacctgagtggattggattggacttattaatccat
acaaaggtcttactacctacaaccagaaattcaagggcaaggccacattaactgtagacaagtcatccagcacagcctacatggag
ctcctcagtctgacatctgaagactctgcagtctattactgtgcaagatctgggtactatggtgactcggactggtacttcgatgtctgg
ggcgcagggaccacggtcaccgtctcctctgatctggagcccaaatcttctgacaaaactcacacatcccccaccgtcccagcac
ctgaactcctgggggggaccgtcagtcttcctcttcccccaaaaccaaggacaccctcatgatctcccggacccctgaggtcaca
tgcgtggtggtgagcgtgagccacgaagaccctgaggtcaagttcaactggtacgtggacggcgtggaggtgcataatgccaag
acaaagccgcgggaggagcagtacaacagcacgtaccgtgtggtcagcgtcctcaccgtcctcaccaggactggctgaatgg
caaggagtacaagtgcaaggtctccaacaaagccctcccagcccccatcgagaaaaccatctccaaagccaaagggcagccc
gagaaccacaggtgtacacctgcccccatcccgggatgagctgaccaagaaccaggtcagcctgacctgcctggtcaaaggct
tctatcccagcgacatcgccgtggagtgggagagcaatgggcagccggagaacaactacaagaccacgcctcccgtgctggac
tccgacggctccttcttcctctacagcaagctcaccgtggacaagagcaggtggcagcaggggaacgtcttctcatgctccgtgat
gcatgaggctctgcacaaccactacacgcagaagagcctctccctgtctccgggtaaagcggatccttcgaacctgctcccatcct
gggccattaccttaatctcagtaaatggaattttttgtgatatgctgcctgacctactgctttgccccaagatgcagagagagaaggag
gaatgagagattgagaagggaaagtgtacgccctgtataaatcgat Amino acid sequence (SEQ ID NO: 512):
MDFQVQIFSFLLISASVIMSRGVDIQMTQTTSSLSASLGDRVTISCRASQDIRNYLN
WYQQKPDGTVKLLIYYTSRLHSGVPSRFSGSGSGTDYSLTIANLQPEDIATYFCQQ
GNTLPWTFGGGTKLVTKRELGGGSGGGGSGGGGSIDEVQLQQSGPELVKPGAS
MSCKASGYSFTGYIVNWLKQSHGKNLEWIGLINPYKGLTTYNQKFKGKATLTVD
KSSSTAYMELLSLTSEDSAVYYCARSGYYGDSDWYFDVWGAGTTVTVSSDLEPK
SSDKTHTSPPSPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKA
LPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQ
KSLSLSPGKADPSNLLPSWAITLISVNGIFVICCLTYCFAPRCRERRRNERLRRESVR
PV HCD16lowFL + NL
Nucleotide sequence (SEQ ID NO: 513):
aagcttgccgccatgtggcagctgctcctcccaactgctctgctacttctagtttcagctggcatgcggactgaagatctcccaagg
ctgtggtgttcctggagcctcaatggtacagggtgctcgagaaggacagtgtgactctgaagtgccaggagcctactccctgag
gacaattccacacagtggtttcacaatgagagcctcatctcaagccaggcctcgagctacttcattgacgctgccacagtcgacgac -continued

```
agtggagagtacaggtgccagacaaacctctccaccctcagtgacccggtgcagctagaagtccatatcggctggctgttgctcca
ggcccctcggtgggtgttcaaggaggaagaccctattcacctgaggtgtcacagctggaagaacactgctctgcataaggtcacat
atttacagaatggcaaaggcaggaagtattttcatcataattctgacttctacattccaaaagccacactcaaagacagcggctcctac
ttctgcagggggcttgttgggagtaaaaatgtgtcttcagagactgtgaacatcaccatcactcaaggtttggcagtgtcaaccatctc
atcattctttccacctgggtaccaagtctctttctgcttggtgatggtactccttttgcagtggacacaggactatatttctctgtgaaga
caaacattcgaagctcaacaagagactggaaggaccataaatttaaatggagaaaggaccctcaagacaaatgaccc
```

Amino acid sequence (SEQ ID NO: 514):
MWQLLLPTALLLLVSAGMRTEDLPKAVVFLEPQWYRVLEKDSVTLKCQGAYSPE
DNSTQWFHNESLISSQASSYFIDAATVDDSGEYRCQTNLSTLSDPVQLEVHIGWLL
LQAPRWVFKEEDPIHLRCHSWKNTALHKVTYLQNGKGRKYFHHNSDFYIPKATL
KDSGSYFCRGLVGSKNVSSETVNITITQGLAVSTISSFFPPGYQVSFCLVMVLLFAV
DTGLYFSVKTNIRSSTRDWKDHKFKWRXDPQDK From the foregoing, it will be appreciated that, although specific embodiments of the invention have been described herein for the purpose of illustration, various modifications may be made without deviating from the spirit and scope of the invention. Accordingly, the present invention is not limited except as by the appended claims.

All patents, patent applications, publications, scientific articles, web sites, and other documents and materials referenced or mentioned herein are indicative of the levels of skill of those skilled in the art to which the invention pertains, and each such referenced document and material is hereby incorporated by reference to the same extent as if it had been incorporated by reference in its entirety individually or set forth herein in its entirety. Additionally, all claims in this application, and all priority applications, including but not limited to original claims, are hereby incorporated in their entirety into, and form a part of, the written description of the invention. Applicants reserve the right to physically incorporate into this specification any and all materials and information from any such patents, applications, publications, scientific articles, web sites, electronically available information, and other referenced materials or documents. Applicants reserve the right to physically incorporate into any part of this document, including any part of the written description, the claims referred to above including but not limited to any original claims.

The specific methods and compositions described herein are representative of preferred embodiments and are exemplary and not intended as limitations on the scope of the invention. Other objects, aspects, and embodiments will occur to those skilled in the art upon consideration of this specification, and are encompassed within the spirit of the invention as defined by the scope of the claims. It will be readily apparent to one skilled in the art that varying substitutions and modifications may be made to the invention disclosed herein without departing from the scope and spirit of the invention. The invention illustratively described herein suitably may be practiced in the absence of any element or elements, or limitation or limitations, which is not specifically disclosed herein as essential. Thus, for example, in each instance herein, in embodiments or examples of the present invention, any of the terms "comprising", "consisting essentially of", and "consisting of may be replaced with either of the other two terms in the specification. Also, the terms "comprising", "including", containing", etc. are to be read expansively and without limitation. The methods and processes illustratively described herein suitably may be practiced in differing orders of steps, and that they are not necessarily restricted to the orders of steps indicated herein or in the claims. It is also that as used herein and in the appended claims, the singular forms "a," "an," and "the" include plural reference unless the context clearly dictates otherwise. Thus, for example, a reference to "a host cell" includes a plurality (for example, a culture or population) of such host cells, and so forth. Under no circumstances may the patent be interpreted to be limited to the specific examples or embodiments or methods specifically disclosed herein. Under no circumstances may the patent be interpreted to be limited by any statement made by any Examiner or any other official or employee of the Patent and Trademark Office unless such statement is specifically and without qualification or reservation expressly adopted in a responsive writing by Applicants.

The terms and expressions that have been employed are used as terms of description and not of limitation, and there is no intent in the use of such terms and expressions to exclude any equivalent of the features shown and described or portions thereof, but it is recognized that various modifications are possible within the scope of the invention as claimed. Thus, it will be understood that although the present invention has been specifically disclosed by preferred embodiments and optional features, modification and variation of the concepts herein disclosed may be resorted to by those skilled in the art, and that such modifications and variations are considered to be within the scope of this invention as defined by the appended claims.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein. For example, the subject matter of the instant invention may optionally exclude any of the subject matter or sequences described or included in related application published as U.S.S.N. 2003/0118592 A1 on Jun. 26, 2003 (and the sequence listings of SEQ ID NOS: 1-427 published by USPTO), by Ledbetter et al. entitled "Binding Domain-Immunoglobulin Fusion Proteins".

Other embodiments are within the following claims. In addition, where features or aspects of the invention are described in terms of Markush groups, those skilled in the art will recognize that the invention is also thereby described in terms of any individual member or subgroup of members of the Markush group.

SEQUENCE LISTING (699 sequences)

SEQ ID NO: 1 - DNA, 714 bp, Homo sapiens
tctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 2 - protein, 235 aa, Homo sapiens
SDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - DNA, 718 bp, Lama glama
  modified_base (34)..(34): n is a, c, g, or t
  modified_base (43)..(43): n is a, c, g, or t
  modified_base (52)..(52): n is a, c, g, or t
  modified_base (55)..(55): n is a, c, g, or t
  modified_base (58)..(58): n is a, c, g, or t
  modified_base (64)..(64): n is a, c, g, or t
tgatcaagaaccacatggaggatgcacgtgcccncagtgcccncaatgcccngcnccngaactnccaggaggcccttctgtctttgtcttccccccgaaacccaaggacgtcctctccatttttggaggccgagtcacgtgcgttgtagtggacgtcggaaagaaagaccccgaggtcaatttcaactggtatattgatggcgttgaggtgcgaacggccaatacgaagccaaaagaggaacagttcaacagcacgtaccgcgtggtcagcgtcctgcccatccagcaccaggactggctgacggggaaggaattcaagtgcaaggtcaacaacaaagctctcccggcccccatcgagaggaccatctccaaggccaaagggcagacccgggagccgcaggtgtacaccctggccccacaccgggaagaactggccaaggacaccgtgagcgtaacatgcctggtcaaaggcttctacccagctgacatcaacgttgagtggcagaggaacggtcagccggagtcagagggcacctacgccaacacgccgccacagctggacaacgacgggacctacttcctctacagcaagctctcggtgggaaagaacacgtggcagcggggagaaaccttaacctgtgtggtgatgcatgaggccctgcacaaccactacacccagaaatccatcacccagtcttcgggtaaatagtaatctaga

SEQ ID NO: 4 - protein, 231 aa, Lama glama
EPHGGCTCPQCPAPELPGGPSVFVFPPKPKDVLSISGRPEVTCVVVDVGKEDPEVNFNWYIDGVEVRTANTKPKEEQFNSTYRVVSVLPIQHQDWLTGKEFKCKVNNKALPAPIERTISKAKGQTREPQVYTLAPHREELAKDTVSVTCLVKGFYPADINVEWQRNGQPESEGTYANTPPQLDNDGTYFLYSRLSVGKNTWQRGETLTGVVMHEALHNHYTQKSITQSSGK

SEQ ID NO: 5 - DNA, 757 bp, Lama glama
tgatcaagaacccaagacaccaaaaccacaaccacaaccacaaccacaacccaatcctacaacagaatccaagtgtcccaaatgtccagcccctgagctcctgggagggccctcagtcttcatcttccccccgaaacccaaggacgtcctctccatttctgggaggcccgaggtcacgtgcgttgtggtagacgtgggccaggaagaccccgaggtcagtttcaactggtacattgatggcgctgaggtgcgaacggccaacacgaggccaaaagaggaacagttcaacagcacgtaccgcgtggtcagcgtcctgcccatccagcaccaggactggctgacggggaaggaattcaagtgcaaggtcaacaacaaagctctcccggcccccatcgagaagaccatctccaaggccaaagggcagacccgggagccgcaggtgtacaccctggccccacaccgggaagagctggccaaggacaccgtgagcgtaacatgcctggtcaaaggcttctacccacctgatatcaacgttgagtggcagaggaatgggcagccggagtcagagggcacytacgccaccacgccaccccagctggacaacgacgggacctacttcctctacagcaagctctcggtgggaaagaacacgtggcagcagggagaaaccttcacctgtgtggtgatgcacgaggccctgcacaaccactacacccagaaatccatcacccagtcttcgggtaaatagtaatctaga

SEQ ID NO: 6 - protein, 248 aa, Lama glama
DQEPKTPKPQPQPQPQPNPTTESKCPKCPAPELLGGPSVFIFPPKPKDVLSISGRPEVTCVVVDVGQEDPEVSFNWYIDGAEVRTANTRPKEEQFNSTYRVVSVLPIQHQDWLTGKEFKCKVNNKALPAPIEKTISKAKGQTREPQVYTLAPHREELAKDTVSVTCLVKGFYPPDINVEWQRNGQPESEGTYATTPPQLDNDGTYFLYSKLSVGKNTWQQGETFTCVVMHEALHNHYTQKSITQSSGK

SEQ ID NO: 7 - DNA, 727 bp, Lama glama
tgatcaagcgcaccacagcgaagaccccagctccaagtgtcccaaatgcccaggccctgaactccttggagggcccacggtcttcatcttccccccgaaagccaaggacgtcctctccatcacccgaaaacctgaggtcacgtgcttgtggtggacgtgggtaaagaagaccctgagatcgagttcaagctggtccgtggatgacacagaggtacacacggctgagacaaagccaaaggaggaacagttcaacagcacgtaccgcgtggtcagcgtcctgcccatccagcaccaggactggctgacggggaaggaattcaagtgcaaggtcaacaacaaagctctcccagcccccatcgagaggaccatctccaaggccaaagggcagacccgggagccgcaggtgtacaccctggccccacaccgggaagagctggccaaggacaccgtgagcgtaacctgcctggtcaaaggcttcttcccagctgacatcaacgttgagtggcagaggaatgggcagccggagtcagagggcacctacgccaacacgccgccacagctggacaacgacgggacctacttcctctacagcaaactctccgtgggaaagaacacgtggcagcagggagaagtcttcacctgtgtggtgatgcacgaggctctacacaatcactccacccagaaatccatcacccagtcttcgggtaaatagtaatctagagggccc

SEQ ID NO: 8 - protein, 236 aa, Lama glama
DQAHHSEDPSSKCPKCPGPELLGGPTVFIFPPKAKDVLSITRKPEVTCLWWTWVKKTLRSSSSWSVDDTEVHTAETKPKEEQFNSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 9 - DNA, 54 bp, Homo sapiens
gatcaggagcccaaatcttgtgacaaaactcacacatgcccaccgtgcccagca

SEQ ID NO: 10 - protein, 18 aa, Homo sapiens
DQEPKSCDKTHTCPPCPA

SEQ ID NO: 11 - DNA, 54 bp, Homo sapiens
gatctggagcccaaatcttgtgacaaaactcacacatgcccaccgtgcccagca

SEQ ID NO: 12 - protein, 18 aa, Homo sapiens
DLEPKSCDKTHTCPPCPA

SEQ ID NO: 13 - DNA, 327 bp, Homo sapiens
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaa

SEQ ID NO: 14 - protein, 109 aa, Homo sapiens
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 15 - DNA, 324 bp, Homo sapiens
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 16 - protein, 107 aa, Homo sapiens
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 54 bp, Homo sapiens
gatcaggagcccaaatcttctgacaaaactcacacatccccaccgtccccagca

SEQ ID NO: 18 - protein, 18 aa, Homo sapiens
DQEPKSSDKTHTSPPSPA

SEQ ID NO: 19 - DNA, 712 bp, Artificial Sequence
  Description of Artificial Synthetic nucleotide sequence
tgatcaccccaaatcttctgacaaaactcacacatctccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataatctaga

SEQ ID NO: 20 - protein, 233 aa, Artificial Sequence
  Description of Artificial Synthetic amino acid sequence
DHPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - DNA, 1527 bp, Lama glama
  modified_base (843)..(843): n is a, c, g, or t
  modified_base (852)..(852): n is a, c, g, or t
  modified_base (861)..(861): n is a, c, g, or t
  modified_base (864)..(864): n is a, c, g, or t
  modified_base (867)..(867): n is a, c, g, or t
  modified_base (873)..(873): n is a, c, g, or t
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaaccacatggaggatgcacgtgcccncagtgcccncaatgcccngcnccngaactnccaggaggcccttctgtctttgtcttccccccgaaacccaaggacgtcctctccatttttggaggccgagtcacgtgcgttgtagtggacgtcggaaagaaagaccccgaggtcaatttcaactggtatattgatggcgttgaggtgcgaacggccaatacgaagccaaaagaggaacagttcaacagcacgtaccgcgtggtcagcgtcctgcccatccagcaccaggactggctgacggggaaggaattcaagtgcaaggtcaacaacaaagctctcccggcccccatcgagaggaccatctccaaggccaaagggcagacccgggagccgcaggtgtacaccctggccccacaccgggaagaactggccaaggacaccgtgagcgtaacatgcctggtcaaaggcttctacccagctgacatcaacgttgagtggcagaggaacggtcagccggagtcagagggcacctacgccaacacgccgccacagctggacaacgacgggacctacttcctctacagcaagctctcggtgggaaagaacacgtggcagcggggagaaaccttaacctgtgtggtgatgcatgaggccctgcacaaccactacacccagaaatccatcacccagtcttcgggtaaatagtaatctaga

SEQ ID NO: 22 - protein, 498 aa, Lama glama
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPHGGCTCPQCPAPELPGGPSVFVFPPKPKDVLSIFGGRVTCVVVDVGKKDPEVNFNWYIDGVEVRTANTKPKEEQFNSTYRVVSVLPIQHQDWLTGKEFKCKVNNKALPAPIERTISKAKGQTREPQVYTLAPHREELAKDTVSVTCLVKGFYPADINVEWQRNGQPESEGTYANTPPQLDNDGTYFLYSKLSVGKNTWQRGETLTCVVMHEALHNHYTQKSITQSSGK

SEQ ID NO: 23 - DNA, 1566 bp, Lama glama
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagaacccaagacaccaaaaccacaaccacaaccacaaccacaacccaatcctacaacagaatccaagtgtcccaaatgtccagcccctgagctcctgggagggccctcagtcttcatcttccccccgaaacccaaggacgtcctctccatttctgggaggcccgaggtcacgtgcgttgtggtagacgtgggccaggaagaccccgaggtcagtttcaactggtacattgatggcgctgaggtgcgaacggccaacacgaggccaaaagaggaacagttcaacagcacgtaccgcgtggtcagcgtcctgcccatccagcaccaggactggctgacggggaaggaattcaagtgcaaggtcaacaacaaagctctcccggcccccatcgagaagaccatctccaaggccaaagggcagacccgggagccgcaggtgtacaccctggccccacaccgggaagagctggccaaggacaccgtgagcgtaacatgcctggtcaaaggcttctacccacctgatatcaacgttgagtggcagaggaatgggcagccggagtcagagggcacytacgccaccacgccaccccagctggacaacgacgggacctacttcctctacagcaagctctcggtgggaaagaacacgtggcagcagggagaaaccttcacctgtgtggtgatgcacgaggccctgcacaaccactacacccagaaatccatcacccagtcttcgggtaaatagtaatctaga

SEQ ID NO: 24 - protein, 514 aa, Lama glama
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKTPKPQPQPQPQPNPTTESKCPKCPAPELLGGPSVFIFPPKPKDVLSISGRPEVTCVVVDVGQEDPEVSFNWYIDGAEVRTANTRPKEEQFNSTYRVVSVLPIQHQDWLTGKEFKCKVNNKALPAPIEKTISKAKGQTREPQVYTLAPHREELAKDTVSVTCLVKGFYPPDINVEWQRNGQPESEGTYATTPPQLDNDGTYFLYSKLSVGKNTWQQGETFTCVVMHEALHNHYTQKSITQSSGK

SEQ ID NO: 25 - DNA, 1536 bp, Lama glama
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaagcgaaccacagcgaagaccccagctccaagtgtcccaaatgcccaggccctgaactccttggagggcccacggtcttcatcttccccccgaaagccaaggacgtcctctccatcacccgaaaacctgaggtcacgtgcttgtggtggacgtgggtaaagaagaccctgagatcgagttcaagctggtccgtggatgacacagaggtacacacggctgagacaaagccaaaggaggaacagttcaacagcacgtaccgcgtggtcagcgtcctgcccatccagcaccaggactggctgacggggaaggaattcaagtgcaaggtcaacaacaaagctctcccagcccccatcgagaggaccatctccaaggccaaagggcagacccgggagccgcaggtgtacaccctggccccacaccgggaagagctggccaaggacaccgtgagcgtaacctgcctggtcaaaggcttcttcccagctgacatcaacgttgagtggcagaggaatgggcagccggagtcagagggcacctacgccaacacgccgccacagctggacaacgacgggacctacttcctctacagcaaactctccgtgggaaagaacacgtggcagcagggagaagtcttcacctgtgtggtgatgcacgaggctctacacaatcactccacccagaaatccatcacccagtcttcgggtaaatagtaatctagagggccc

SEQ ID NO: 26 - protein, 503 aa, Lama glama
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQAHSHSEDPSSKCPKCPGPELLGGPTVFIFPPKAKDVLSITRKPEVTCLWWTWVKKTLRSSSSWSVDDTEVHTAETKPKEEQFNSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 27 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 28 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - DNA, 162 bp, Artificial sequence
  Description of Artificial Synthetic nucleotide sequence
gcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 30 - protein, 51 aa, Artificial sequence
  Description of Artificial Synthetic amino acid sequence
ADPSNLLPSWAITLISVNGIFVICCLTYCFAPRCRERRRNERLRRESVRPV

SEQ ID NO: 31 - DNA, 399 bp, Artificial sequence
  Description of Artificial Synthetic nucleotide sequence
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacgg

SEQ ID NO: 32 - protein, 131 aa, Artificial sequence
  Description of Artificial Synthetic amino acid sequence
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKR

SEQ ID NO: 33 - DNA, 368 bp, Artificial sequence
  Description of Artificial Synthetic nucleotide sequence
cagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatca

SEQ ID NO: 34 - protein, 121 aa, Artificial sequence
  Description of Artificial Synthetic amino acid sequence
QIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 35 - DNA, 812 bp, Artificial sequence
  Description of Artificial Synthetic nucleotide sequence
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatca

SEQ ID NO: 36 - protein, 267 aa, Artificial sequence
  Description of Artificial Synthetic amino acid sequence
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVS

SEQ ID NO: 37 - DNA, 405 bp, Artificial sequence
  Description of Artificial Synthetic nucleotide sequence
atggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacgg

SEQ ID NO: 38 - protein, 135 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKR

SEQ ID NO: 39 - DNA, 369 bp, Artificial sequence
  Description of Artificial Synthetic nucleotide sequence
caggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctg

SEQ ID NO: 40 - protein, 121 aa, Artificial sequence
  Description of Artificial Synthetic amino acid sequence
QVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSS

SEQ ID NO: 41 - DNA, 825 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctctgatcag

SEQ ID NO: 42 - protein, 271 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSS

SEQ ID NO: 43 - DNA, 393 bp, Artificial sequence
  Description of Artificial Synthetic nucleotide sequence
atggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacgg

SEQ ID NO: 44 - protein, 131 aa, Artificial sequence
  Description of Artificial Synthetic amino acid sequence
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKR

SEQ ID NO: 45 - DNA, 362 bp, Artificial sequence
  Description of Artificial Synthetic nucleotide sequence
gatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatca

SEQ ID NO: 46 - protein, 119 aa, Artificial sequence
  Description of Artificial Synthetic amino acid sequence
DVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSS

SEQ ID NO: 47 - DNA, 806 bp, Artificial sequence
  Description of Artificial Synthetic nucleotide sequence
aagcttatggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacggggtggcggtggctcgggcggtggtgggtcgggtggcggcggatctgatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatca

SEQ ID NO: 48 - protein, 266 aa, Artificial sequence
  Description of Artificial Synthetic amino acid sequence
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKRGGGGSGGGGSGGGGSDVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSSD

SEQ ID NO: 49 - DNA, 1671 bp, Artificial sequence
  Description of Artificial Synthetic nucleotide sequence
aagcttatggattttcaagtgcagattttcagcttcctgctaatcagtgcttcagtcataatgtccagaggagtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 50 - protein, 552 aa, Artificial sequence
  Description of Artificial Synthetic amino acid sequence
MDFQVQIFSFLLISASVIMSRGVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 51 - DNA, 1683 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 52 - protein, 556 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 53 - DNA, 1665 bp, Artificial sequence
  Description of Artificial Synthetic nucleotide sequence
aagcttatggattttcaagtgcagattttcagcttcctgctaatcagtgcttcagtcataatgtccagaggagtcgacatccagatgacacagtctccatcctcactgtctgcatctctgggaggcaaagtcaccatcacttgcaaggcaagccaagacattaagaagtatataggttggtaccaacacaagcctggaaaaggtcccaggctgctcatatattacacatctacattacagccaggcatcccatcaaggttcagtggaagtgggtctgggagagattattccctcagcatcagaaacctggagcctgaagatattgcaacttattattgtcaacagtatgataatcttccattgacgttcggctcggggacaaagttggaaataaaacggggtggcggtggctcgggcggtggtgggtcgggtggcggcggatctgatgtacagcttcaggagtcaggacctggcctcgtgaaaccttctcagtctctgtctctcacctgctctgtcactggctactccatcaccagtggtttctactggaactggatccgacagtttccgggaaacaaactggaatggatgggccacataagccacgacggtaggaataactacaacccatctctcataaatcgaatctccatcactcgtgacacatctaagaaccagtttttcctgaagttgagttctgtgactactgaggacacagctacatatttctgtgcaagacactacggtagtagcggagctatggactactggggtcaaggaacctcagtcaccgtctcctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 54 - protein, 550 aa, Artificial sequence
  Description of Artificial Synthetic amino acid sequence
MDFQVQIFSFLLISASVIMSRGVDIQMTQSPSSLSASLGGKVTITCKASQDIKKYIGWYQHKPGKGPRLLIYYTSTLQPGIPSRFSGSGSGRDYSLSIRNLEPEDIATYYCQQYDNLPLTFGSGTKLEIKRGGGGSGGGGSGGGGSDVQLQESGPGLVKPSQSLSLTCSVTGYSITSGFYWNWIRQFPGNKLEWMGHISHDGRNNYNPSLINRISITRDTSKNQFFLKLSSVTTEDTATYFCARHYGSSGAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 55 - DNA, 1653 bp, Artificial sequence
  Description of Artificial Synthetic nucleotide sequence
atgttgtatacatctcagctccttgggcttttactcttctggatttcagcctccagaagtgacatagtgctgactcagactccagccactctgtctctaattcctggagaaagagtcacaatgacctgtaagaccagtcagaatattggcacaatcttacactggtatcaccaaaaaccaaaggaggctccaagggctctcatcaagtatgcttcgcagtccattcctgggatcccctccagattcagtggcagtggttcggaaacagatttcactctcagcatcaataacctggagcctgatgatatcggaatttattactgtcaacaaagtagaagctggcctgtcacgttcggtcctggcaccaagctggagataaaacggggtggcggtggctcgggcggaggtgggtcgggtggcggcggatctcaggtcaagctgcagcagtccggttctgaactagggaaacctggggcctcagtgaaactgtcctgcaagacttcaggctacatattcacagatcactatatttcttgggtgaaacagaagcctggagaaagcctgcagtggataggaaatgtttatggtggaaatggtggtacaagctacaatcaaaaattccagggcaaggccacactgactgtagataaaatctctagcacagcctacatggaactcagcagcctgacatctgaggattctgccatctattactgtgcaagaaggccggtagcgacgggccatgctatggactactggggtcaggggatccaagttaccgtctcctctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 56 - protein, 548 aa, Artificial sequence
  Description of Artificial Synthetic amino acid sequence
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIKRGGGGSGGGGSGGGGSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 57 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 58 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - DNA, 1536 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 60 - protein, 505 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 1584 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 62 - protein, 520 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 63 - DNA, 775 bp, Artificial Sequence
  Description of Artificial Synthetic nucleotide sequence
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 64 - protein, 254 aa, Artificial Sequence
  Description of Artificial Synthetic amino acid sequence
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 65 - DNA, 429 bp, Homo sapiens
agatctcaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctcagctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatctaga

SEQ ID NO: 66 - protein, 139 aa, Homo sapiens
RSQEDERIVLVDNKCKCARITSRIIRSSEDPNEDIVERNIRIIVPLNNRENISDPTSPLRTRFVYHLSDLSCKKCDPTEVELDNQIVTATQSNICDEDSATETCYTYDRNKCYTAVVPLVYGGETKMVETALTPDACYP

SEQ ID NO: 67 - protein, 4 aa, Artificial sequence
  Description of Artificial Synthetic amino acid sequence
GTCY

SEQ ID NO: 68 - DNA, 763 bp, Artificial sequence
  Description of Artificial Synthetic nucleotide sequence
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 69 - protein, 250 aa, Artificial sequence
  Description of Artificial Synthetic amino acid sequence
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 70 - DNA, 1572 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 71 - protein, 516 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 72 - protein, 14 aa, Artificial sequence
  Description of Artificial Synthetic peptide
PTHVNVSVVMAEVD

SEQ ID NO: 73 - DNA, 709 bp, Artificial sequence
  Description of Artificial Synthetic nucleotide sequence
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaa

SEQ ID NO: 74 - protein, 236 aa, Artificial sequence
  Description of Artificial Synthetic amino acid sequence
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGK

SEQ ID NO: 75 - DNA, 1518 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaa

SEQ ID NO: 76 - protein, 502 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGK

SEQ ID NO: 77 - DNA, 924 bp, Artificial Sequence
  Description of Artificial Synthetic nucleotide sequence
gcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaacccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 78 - protein, 382 aa, Artificial sequence
  Description of Artificial Synthetic amino acid sequence
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - DNA, 453 bp, Homo sapiens
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaa

SEQ ID NO: 80 - protein, 151 aa, Homo sapiens
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQ

SEQ ID NO: 81 - DNA, 75 bp, Homo sapiens
atgggggtactgctcacacagaggacgctgctcagtctggtccttgcactcctgtttccaagcatggcgagcatg

SEQ ID NO: 82 - protein, 22 aa, Homo sapiens
MGVLLTQRTLLSLVLALLFPSM

SEQ ID NO: 83 - DNA, 372 bp, Homo sapiens
gcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattct

SEQ ID NO: 84 - protein, 124 aa, Homo sapiens
AMHVAQPAVVLASSRGIASFVCEYASPGKATEVRVTVLRQADSQVTEVCAATYMTGNELTFLDDSICTGTSSGNQVNLTIQGLRAMDTGLYICKVELMYPPPYYLGIGNGTQIYVIDPEPCPDS

SEQ ID NO: 85 - DNA, 1149 bp, Homo sapiens
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaacccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 86 - protein, 382 aa, Homo sapiens
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - DNA, 1221 bp, Artificial Sequence
  Description of Artificial Synthetic nucleotide sequence
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 88 - protein, 403 aa, Artificial sequence
  Description of Artificial Synthetic amino acid sequence
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 89 - DNA, 1209 bp, Artificial Sequence
  Description of Artificial Synthetic nucleotide sequence
atgggggtactgctcacacagaggacgctgctcagtctggtccttgcactcctgtttccaagcatggcgagcatggcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 90 - protein, 399 aa, Artificial sequence
  Description of Artificial Synthetic amino acid sequence
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 91 - DNA, 328 bp, Homo sapiens
cctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaag

SEQ ID NO: 92 - protein, 109 aa, Homo sapiens
PELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 93 - protein, 10 aa, Artificial sequence
  Description of Artificial Synthetic peptide
PAPELLGGPS

SEQ ID NO: 94 - protein, 10 aa, Artificial sequence
  Description of Artificial Synthetic peptide
PAPELLGGSS

SEQ ID NO: 95 - DNA, 51 bp, Artificial sequence
  Description of Artificial Synthetic nucleotide sequence
gttgttttcgaaggatccgctttaccgggatttacagacaccgctcgctgg

SEQ ID NO: 96 - DNA, 996 bp, Homo sapiens
tgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaa

SEQ ID NO: 97 - protein, 331 aa, Homo sapiens
DHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGKADPS

SEQ ID NO: 98 - DNA, 63 bp, Artificial sequence
  Description of Artificial Synthetic nucleotide sequence
gttgtttgatcaggagcccaaatcttgtgacaaaactcacacatgcccaccgtgcccagcacc

SEQ ID NO: 99 - DNA, 91 bp, Artificial sequence
  Description of Artificial Synthetic nucleotide sequence
gttgttgatcaggagcccaaatcttctgacaaaactcacacatctccaccgtccccagcacctgaactcctgggtggaccgtcagtcttcc

SEQ ID NO: 100 - DNA, 339 bp, Artificial sequence
  Description of Artificial Synthetic nucleotide sequence
caggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctct

SEQ ID NO: 101 - protein, 113 aa, Artificial sequence
  Description of Artificial Synthetic amino acid sequence
QVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSS

SEQ ID NO: 102 - DNA, 321 bp, Artificial sequence
  Description of Artificial Synthetic nucleotide sequence
gacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacgg

SEQ ID NO: 103 - protein, 107 aa, Artificial sequence
  Description of Artificial Synthetic amino acid sequence
DIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKR

SEQ ID NO: 104 - DNA, 785 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatca

SEQ ID NO: 105 - protein, 258 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSS

SEQ ID NO: 106 - DNA, 1491 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 107 - protein, 492 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - DNA, 1645 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 109 - protein, 543 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 110 - DNA, 1645 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 111 - protein, 543 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 112 - DNA, 1527 bp, Artificial sequence
  Description of Artificial Synthetic nucleotide sequence
aagcttatggattttcaagtgcagattttcagcttcctgctaatcagtgcttcagtcataatgtccagaggagtcgacatccagatgacacagactacatcctccctgtctgcctctctgggagacagagtcaccatcagttgcagggcaagtcaggacattcgcaattatttaaactggtatcagcagaaaccagatggaactgttaaactcctgatctactacacatcaagattacactcaggagtcccatcaaggttcagtggcagtgggtctggaacagattattctctcaccattgccaacctgcaaccagaagatattgccacttacttttgccaacagggtaatacgcttccgtggacgttcggtggaggcaccaaactggtaaccaaacgggagctcggtggcggtggctcgggcggtggtgggtcgggtggcggcggatctatcgatgaggtccagctgcaacagtctggacctgaactggtgaagcctggagcttcaatgtcctgcaaggcctctggttactcattcactggctacatcgtgaactggctgaagcagagccatggaaagaaccttgagtggattggacttattaatccatacaaaggtcttactacctacaaccagaaattcaagggcaaggccacattaactgtagacaagtcatccagcacagcctacatggagctcctcagtctgacatctgaagactctgcagtctattactgtgcaagatctgggtactatggtgactcggactggtacttcgatgtctggggcgcagggaccacggtcaccgtctcctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 113 - protein, 504 aa, Artificial sequence
  Description of Artificial Synthetic amino acid sequence
MDFQVQIFSFLLISASVIMSRGVDIQMTQTTSSLSASLGDRVTISCRASQDIRNYLNWYQQKPDGTVKLLIYYTSRLHSGVPSRFSGSGSGTDYSLTIANLQPEDIATYFCQQGNTLPWTFGGGTKLVTKRELGGGGSGGGGSGGGGSIDEVQLQQSGPELVKPGASMSCKASGYSFTGYIVNWLKQSHGKNLEWIGLINPYKGLTTYNQKFKGKATLTVDKSSSTAYMELLSLTSEDSAVYYCARSGYYGDSDWYFDVWGAGTTVTVSSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - DNA, 2325 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaatccaactctgaagaagcaaagaaagaggaggccaaaaaggaggaagccaagaaatctaacagcgtcgacattgttctgactcagtctccagccaccctgtctgtgactccaggagatagagtctctctttcctgcagggccagccagagtattagcgactacttacactggtatcaacaaaaatcacatgagtctccaaggcttctcatcaaatatgcttcccattccatctctgggatcccctccaggttcagtggcagtggatcagggtcagatttcactctcagtatcaacagtgtggaacctgaagatgttggaatttattactgtcaacatggtcacagctttccgtggacgttcggtggaggcaccaagctggaaatcaaacggggtggcggtggctcgggcggaggtgggtcgggtggcggcggatctcagatccagttggtgcaatctggacctgagctgaagaagcctggagagacagtcaggatctcctgcaaggcttctgggtatgccttcacaactactggaatgcagtgggtgcaagagatgccaggaaagggtttgaagtggattggctggataaacaccccactctggagtgccaaaatatgtagaagacttcaaggacggtttgccttctctttggaaacctctgccaacactgcatatttacagataagcaacctcaaagatgaggacacggctacgtatttctgtgtgagatccgggaatggtaactatgacctggcctactttgcttactggggccaagggacactggtcactgtctctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 115 - protein, 768 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQSNSEEAKKEEAKKEEAKKSNSVDIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRGGGGSGGGGSGGGGSQIQLVQSGPELKKPGETVRISCKASGYAFTTTGMQWVQEMPGKGLKWIGWINTPLWSAKICRRLQGRFAFSLETSANTAYLQISNLKDEDTATYFCVRSGNGNYDLAYFAYWGQGTLVTVSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - DNA, 423 bp, Artificial sequence
  Description of Artificial Synthetic nucleotide sequence
atggctgtcttggggctgctcttctgcctggtgacatttccaagctgtgtcctatcccaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctca

SEQ ID NO: 117 - DNA, 366 bp, Artificial sequence
  Description of Artificial Synthetic nucleotide sequence
caggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctca

SEQ ID NO: 118 - protein, 141 aa, Artificial sequence
  Description of Artificial Synthetic amino acid sequence
MAVLGLLFCLVTFPSCVLSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 119 - protein, 122 aa, Artificial sequence
  Description of Artificial Synthetic amino acid sequence
QVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 120 - DNA, 399 bp, Artificial sequence
  Description of Artificial Synthetic nucleotide sequence
atgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacgg

SEQ ID NO: 121 - protein, 133 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKR

SEQ ID NO: 122 - DNA, 825 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctct

SEQ ID NO: 123 - protein, 271 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 124 - DNA, 1696 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatactcgag

SEQ ID NO: 125 - protein, 556 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 126 - DNA, 1683 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 127 - protein, 556 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 128 - DNA, 1800 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 129 - protein, 592 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 130 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 131 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - DNA, 1536 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 133 - protein, 505 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 135 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatgcccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 137 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 139 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - DNA, 44 bp, Artificial sequence
  Description of Artificial Synthetic primer
gttgttgatcaggagcccaaatcttctgacaaaactcacacatg

SEQ ID NO: 141 - DNA, 54 bp, Artificial sequence
  Description of Artificial Synthetic primer
gttgttgatcaggagcccaaatcttgtgacaaaactcacacatctccaccgtgc

SEQ ID NO: 142 - DNA, 63 bp, Artificial sequence
  Description of Artificial Synthetic primer
gttgttgatcaggagcccaaatcttgtgacaaaactcacacatgtccaccgtccccagcacct

SEQ ID NO: 143 - DNA, 324 bp, Artificial Sequence
  Description of Artificial Synthetic nucleotide sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 144 - protein, 107 aa, Artificial Sequence
  Description of Artificial Synthetic amino acid sequence
GQPREPQVYTLPPSREEMTKNQVSLTCLVKGFYPSDIAVEWESNGQPENNYKTTPPVLDSDGSFYLYSKLTVDKSRWQQGNVFSCSVMHEALHNHYTQKSLSLSPGK

SEQ ID NO: 145 - DNA, 324 bp, Artificial Sequence
  Description of Artificial Synthetic nucleotide sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 146 - protein, 107 aa, Artificial Sequence
  Description of Artificial Synthetic amino acid sequence
GQPREPQVYTLPPSREEMTKNQVSLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 147 - DNA, 324 bp, Artificial Sequence
  Description of Artificial Synthetic nucleotide sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 148 - protein, 107 aa, Artificial Sequence
  Description of Artificial Synthetic amino acid sequence
GQPREPQVYTLPPSREEMTKNQVSLTCLVKGFYPSDIAVEWESNGQPENNYKTTPPVLDSDGSFFLASKLTVDKSRWQQGNVFSCSVMHEALHNHYTQKSLSLSPGK

SEQ ID NO: 149 - DNA, 324 bp, Artificial Sequence
  Description of Artificial Synthetic nucleotide sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 150 - protein, 107 aa, Artificial Sequence
  Description of Artificial Synthetic amino acid sequence
GQPREPQVYTLPPSREEMTKNQVSLTCLVKGFYPSDIAVEWESNGQPENNYKTTPPVLDSDGSFYLASKLTVDKSRWQQGNVFSCSVMHEALHNHYTQKSLSLSPGK

SEQ ID NO: 151 - DNA, 324 bp, Artificial Sequence
  Description of Artificial Synthetic nucleotide sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 152 - protein, 107 aa, Artificial Sequence
  Description of Artificial Synthetic amino acid sequence
GQPREPQVYTLPPSREEMTKNQVSLTCLVKGFYPSDIAVEWESNGQPENNYKTTPPVLDSDGSFALASKLTVDKSRWQQGNVFSCSVMHEALHNHYTQKSLSLSPGK

SEQ ID NO: 153 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctctatagcaagctcaccgtggacaagagcaggtggcagcaggggaacgtcttctcatgctccgtgatgcatgaggctctgcacaaccactacacgcagaagagcctctccctgtccccgggtaaatgatctaga

SEQ ID NO: 154 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFYLYSKLTVDKSRWQQGNVFSCSVMHEALHNHYTQKSLSLSPGK

SEQ ID NO: 155 - DNA, 1515 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 156 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFALYSKLTVDKSRWQQGNVFSCSVMHEALHNHYTQKSLSLSPGK

SEQ ID NO: 157 - DNA, 1515 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 158 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLASKLTVDKSRWQQGNVFSCSVMHEALHNHYTQKSLSLSPGK

SEQ ID NO: 159 - DNA, 1515 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttctacctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 160 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFYLASKLTVDKSRWQQGNVFSCSVMHEALHNHYTQKSLSLSPGK

SEQ ID NO: 161 - DNA, 1515 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgccagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 162 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFALASKLTVDKSRWQQGNVFSCSVMHEALHNHYTQKSLSLSPGK

SEQ ID NO: 163 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 164 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatctccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 166 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - DNA, 1521 bp, Artificial Sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatgtccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 168 - protein, 500 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - DNA, 766 bp, Artificial Sequence
  Description of Artificial Synthetic nucleotide sequence
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaac

SEQ ID NO: 170 - protein, 255 aa, Artificial Sequence
  Description of Artificial Synthetic amino acid sequence
DQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDADPSN

SEQ ID NO: 171 - DNA, 1697 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 172 - protein, 560 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 173 - DNA, 996 bp, Homo sapiens; identical to SEQ ID NO: 96

SEQ ID NO: 174 - protein, 331 aa, Homo sapiens; identical to SEQ ID NO: 97

SEQ ID NO: 175 - DNA, 1921 bp, Homo sapiens
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 176 - protein, 635 aa, Homo sapiens
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGKADPSKLPSWAITLISVNGIFVICCLTYCFAPRCRERRRNERLRRESVRPV

SEQ ID NO: 177 - DNA, 1742 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 178 - protein, 573 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGLVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 179 - DNA, 1966 bp, Homo sapiens
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcggatcgtcacaggtgcagctgaagcagtcaggacctggcctagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 180 - protein, 648 aa, Homo sapiens [sequence omitted]

SEQ ID NO: 181 - DNA, 1736 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacgcggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatac

SEQ ID NO: 182 - protein, 573 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDADPSNNLLPSWAITLISVNGIFVICCLTYCFAPRCRERRRNERLRRESVRPV

SEQ ID NO: 183 - DNA, 1960 bp, Homo sapiens
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaagctcccatcctgggccattaccttaatctcagtaaatggaatttttgtgatatgctgcctgacctactgctttgccccaagatgcagagagagaaggaggaatgagagattgagaagggaaagtgtacgccctgtataaatcgata

SEQ ID NO: 184 - protein, 648 aa, Homo sapiens
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGKADPSKLPSWAITLISVNGIFVICCLTYCFAPRCRERRRNERLRRESVRPV

SEQ ID NO: 185 - DNA, 793 bp, Artificial sequence
  Description of Artificial Synthetic nucleotide sequence
atgttgtatacatctcagctccttgggcttttactcttctggatttcagcctccagaagtgacatagtgctgactcagactccagccactctgtctctaattcctggagaaagagtcacaatgacctgtaagaccagtcagaatattggcacaatcttacactggtatcaccaaaaaccaaaggaggctccaagggctctcatcaagtatgcttcgcagtccattcctgggatcccctccagattcagtggcagtggttcggaaacagatttcactctcagcatcaataacctggagcctgatgatatcggaatttattactgtcaacaaagtagaagctggcctgtcacgttcggtcctggcaccaagctggagataaaacggggtggcggtggctcgggcggaggtgggtcgggtggcggcggatctcaggtcaagctgcagcagtccggttctgaactagggaaacctggggcctcagtgaaactgtcctgcaagacttcaggctacatattcacagatcactatatttcttgggtgaaacagaagcctggagaaagcctgcagtggataggaaatgtttatggtggaaatggtggtacaagctacaatcaaaaattccagggcaaggccacactgactgtagataaaatctctagcacagcctacatggaactcagcagcctgacatctgaggattctgccatctattactgtgcaagaaggccggtagcgacgggccatgctatggactactggggtcaggggatccaagttaccgtctcctctgatc

SEQ ID NO: 186 - protein, 264 aa, Artificial sequence
  Description of Artificial Synthetic amino acid sequence
MLYTSQLLGLLLFWISASRSDIVLTQTPATLSLIPGERVTMTCKTSQNIGTILHWYHQKPKEAPRALIKYASQSIPGIPSRFSGSGSETDFTLSINNLEPDDIGIYYCQQSRSWPVTFGPGTKLEIKRGGGGSGGGGSGGGGSQVKLQQSGSELGKPGASVKLSCKTSGYIFTDHYISWVKQKPGESLQWIGNVYGGNGGTSYNQKFQGKATLTVDKISSTAYMELSSLTSEDSAIYYCARRPVATGHAMDYWGQGIQVTVSSD

SEQ ID NO: 187 - DNA, 47 bp, Artificial sequence
  Description of Artificial Synthetic oligonucleotide
gttgttttcgaaggatccgctttacccggagacagggagaggctctt

SEQ ID NO: 188 - DNA, 45 bp, Artificial sequence
  Description of Artificial Synthetic oligonucleotide
gttgttagatctggagcccaaatcttgtgacaaaactcacacatg

SEQ ID NO: 189 - DNA, 48 bp, Artificial sequence
  Description of Artificial Synthetic oligonucleotide
gttgtggatccttcgaacccgttcctggtgctgctgcactcggtgtcg

SEQ ID NO: 190 - DNA, 48 bp, Artificial sequence
  Description of Artificial Synthetic oligonucleotide
gttgttatcgatctcgagttatcaggacgcttcggaggtagatgcgtc

SEQ ID NO: 191 - DNA, 657 bp, Artificial sequence
  Description of Artificial Synthetic nucleotide sequence
gtggatccttcgaacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgataactcgagatcgataacaac

SEQ ID NO: 192 - protein, 211 aa, Artificial sequence
  Description of Artificial Synthetic amino acid sequence
VDPSNPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 193 - DNA, 60 bp, Artificial sequence
  Description of Artificial Synthetic primer
gttgtggatcctcccttttgggtgctggtggtggttggtgtcctggcttgctatagcttg

SEQ ID NO: 194 - DNA, 60 bp, Artificial sequence
  Description of Artificial Synthetic primer
gttgtttcgaacccagaaaataataaaggccactgttactagcaagctatagcaagccag

SEQ ID NO: 195 - DNA, 32 bp, Artificial sequence
  Description of Artificial Synthetic primer
gttgtggatcctcccttttgggtgctggtggt

SEQ ID NO: 196 - DNA, 33 bp, Artificial sequence
  Description of Artificial Synthetic primer
gttgtttcgaacccagaaaataataaaggccac

SEQ ID NO: 197 - DNA, 28 bp, Artificial sequence
  Description of Artificial Synthetic primer
gttgtggatcctcctgctcccatcctgg

SEQ ID NO: 198 - DNA, 32 bp, Artificial sequence
  Description of Artificial Synthetic primer
gttgtttcgaacggcaaagcagtaggtcaggc

SEQ ID NO: 199 - DNA, 45 bp, Artificial sequence
  Description of Artificial Synthetic primer
gttgtggatccttcgaacccattcctggtgctgctgcactcgctg

SEQ ID NO: 200 - DNA, 42 bp, Artificial sequence
  Description of Artificial Synthetic primer
gttgttatcgatctcgagtcagggtgtttctgaggaagacac

SEQ ID NO: 201 - DNA, 645 bp, Mus sp.
gtggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 202 - protein, 210 aa, Mus sp.
VDPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 203 - DNA, 48 bp, Mus sp.
gttgtggatccttcgaacatggagaacaacaaaacctcagtggattca

SEQ ID NO: 204 - DNA, 45 bp, Mus sp.
gttgttatcgatctcgagctagtgataaaagtacagttctttcgt

SEQ ID NO: 205 - DNA, 46 bp, Mus sp.
gttgtttcgaacatggatttccagagttgtctttatgctattgctg

SEQ ID NO: 206 - DNA, 48 bp, Mus sp.
gttgttatcgatctcgagtcattagggagggaagaagagcttcttccg

SEQ ID NO: 207 - DNA, 45 bp, Homo sapiens
gttgtggatccttcgaacatggagaacactgaaaactcagtggat

SEQ ID NO: 208 - DNA, 48 bp, Homo sapiens
gttgttatcgatctcgagttagtgataaaaatagagttcttttgtgag

SEQ ID NO: 209 - DNA, 45 bp, Homo sapiens
gttgtggatccttcgaacatggacttcagcagaaatctttatgat

SEQ ID NO: 210 - DNA, 48 bp, Homo sapiens
gttgttatcgatgcatgctcaatcagaagggaagacaagtttttttct

SEQ ID NO: 211 - DNA, 816 bp, Artificial sequence
  Description of Artificial Synthetic nucleotide sequence
  modified_base (475)..(477): nucleotide codon can be tcn, acn, gan, can, aan, cgn or agn; n is a, c, g, other or unknown
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagnnngtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcag

SEQ ID NO: 212 - protein, 268 aa, Artificial sequence
  Description of Artificial Synthetic amino acid sequence
  MOD_RES (155)..(155): Xaa can be Ser, Thr, Asp, Glu, Gln, Asn, Arg, Lys or His
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAEXVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQ

SEQ ID NO: 213 - DNA, 813 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgaggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcag

SEQ ID NO: 214 - protein, 267 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAEVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQ

SEQ ID NO: 215 - DNA, 443 bp, Artificial sequence
  Description of Artificial Synthetic nucleotide sequence
  modified_base (391)..(393): nucleotide codon can be tcn, agn, aan, cgn, can, gan and non-natural derivatives of these codons; n is a, c, g, t, other or unknown
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagnnnaaagatggcggtggctcgggcggtggtggatctggaggaggtgggagctc

SEQ ID NO: 216 - protein, 144 aa, Artificial sequence
  Description of Artificial Synthetic amino acid sequence
  MOD_RES (127)..(127): Xaa is Ser, Thr, Arg, Lys, His, Gln, Asn, Asp, Glu, or non-natural derivatives of these amino acids
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLEXKDGGGSGGGGSGGGGSS

SEQ ID NO: 217 - DNA, 440 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagaaagatggcggtggctcgggcggtggtggatctggaggaggtgggagctc

SEQ ID NO: 218 - protein, 143 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLEKDGGGSGGGGSGGGGSS

SEQ ID NO: 219 - DNA, 664 bp, Artificial sequence
  Description of Artificial Synthetic nucleotide sequence
tccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctagaa

SEQ ID NO: 220 - protein, 217 aa, Artificial sequence
  Description of Artificial Synthetic amino acid sequence
SNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 221 - DNA, 719 bp, Artificial sequence
  Description of Artificial Synthetic nucleotide sequence
tgatcaggagcccaaatcttctgacaaaactcacacatccccaccgtccccagcatccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctagaa

SEQ ID NO: 222 - protein, 235 aa, Artificial sequence
  Description of Artificial Synthetic amino acid sequence
DQEPKSSDKTHTSPPSPASNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 223 - DNA, 994 bp, Artificial sequence
  Description of Artificial Synthetic nucleotide sequence
tgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 224 - protein, 327 aa, Artificial sequence
  Description of Artificial Synthetic amino acid sequence
DHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 225 - DNA, 720 bp, Artificial sequence
  Description of Artificial Synthetic nucleotide sequence
tgatcaggagcccaaatcttctgacaaaactcacacatccccaccgtccccagcatccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaagcggatccttcgaa

SEQ ID NO: 226 - protein, 240 aa, Artificial sequence
  Description of Artificial Synthetic amino acid sequence
DQEPKSSDKTHTSPPSPASNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGKSGSFE

SEQ ID NO: 227 - DNA, 1527 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcatccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 228 - protein, 501 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSASNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 229 - DNA, 1527 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtccccagcatccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 230 - protein, 501 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSPASNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 231 - DNA, 443 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctc

SEQ ID NO: 232 - protein, 144 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLESKDGGGSGGGGSGGGGSS

SEQ ID NO: 233 - DNA, 816 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagtctaaagatggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcag

SEQ ID NO: 234 - protein, 268 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLESKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQ

SEQ ID NO: 235 - DNA, 816 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagtctaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcag

SEQ ID NO: 236 - protein, 268 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLESKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQ

SEQ ID NO: 237 - DNA, 199 bp, Homo sapiens
gtggatccaggttcgaagtctccaaaggcacaggcctcctccgtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagaccggtgcagtcgacg

SEQ ID NO: 238 - protein, 66 aa, Homo sapiens
VDPGSKSPKAQASSVPTAQPQAEGSLAKATTAPATTRNTGRGGEEKKKEKEKEEQEERETKTGAVD

SEQ ID NO: 239 - DNA, 222 bp, Artificial sequence
  Description of Artificial Synthetic nucleotide sequence
gagtctccaaaggcacaggcctcctccgtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccct

SEQ ID NO: 240 - protein, 74 aa, Artificial sequence
  Description of Artificial Synthetic amino acid sequence
ESPKAQASSVPTAQPQAEGSLAKATTAPATTRNTGRGGEEKKKEKEKEEQEERETKTPECPSHTQPLGVYLLTP

SEQ ID NO: 241 - DNA, 366 bp, Artificial sequence
  Description of Artificial Synthetic nucleotide sequence
caggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttct

SEQ ID NO: 242 - protein, 122 aa, Artificial sequence
  Description of Artificial Synthetic amino acid sequence
QAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSS

SEQ ID NO: 243 - DNA, 816 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcag

SEQ ID NO: 244 - protein, 268 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQ

SEQ ID NO: 245 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtctgtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatctccaccgtgctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 246 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPCSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - DNA, 1803 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtctgtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 248 - protein, 593 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 249 - DNA, 1822 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtctgtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcacgttcgacctgtcaacatcactgagcccaccttggagctactccattcatcctgcgaccccaatgcattccactccaccatccagctgtactgcttcatttatggccacatcctaaatgatgtctctgtcagctggctaatggacgatcgggagataactgatacacttgcacaaactgttctaatcaaggaggaaggcaaactagcctctacctgcagtaaactcaacatcactgagcagcaatggatgtctgaaagcaccttcacctgcaaggtcacctcccaaggcgtagactatttggcccacactcggagatgcccagatcatgagccacggggtgtgattacctacctgatcccacccagccccctggacctgtatcaaaacggtgctcccaagcttacctgtctggtggtggacctggaaagcgagaagaatgtcaatgtgacgtggaaccaagagaagaagacttcagtctcagcatcccagtggtacactaagcaccacaataacgccacaactagtatcacctccatcctgcctgtagttgccaaggactggattgaaggctacggctatcagtgcatagtggaccaccctgattttcccaagcccattgtgcgttccatcaccaagaccccaggccagcgctcagcccccgaggtatatgtgttcccaccaccagaggaggagagcgaggacaaacgcacactcacctgtttgatccagaacttcttccctgaggatatctctgtgcagtggctgggggatggcaaactgatctcaaacagccagcacagtaccacaacacccctgaaatccaatggctccaatcaaggcttcttcatcttcagtcgcctagaggtcgccaagacactctggacacagagaaaacagttcacctgccaagtgatccatgaggcacttcagaaacccaggaaactggagaaaacaatatccacaagccttggtaacacctccctccgtccatcctagtaatctagag

SEQ ID NO: 250 - protein, 599 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDHVRPVNITEPTLELLHSSCDPNAFHSTIQLYCFIYGHILNDVSVSWLMDDREITDTLAQTVLIKEEGKLASTCSKLNITEQQWMSESTFTCKVTSQGVDYLAHTRRCPDHEPRGVITYLIPPSPLDLYQNGAPKLTCLVVDLESEKNVNVTWNQEKKTSVSASQWYTKHHNNATTSITSILPVVAKDWIEGYGYQCIVDHPDFPKPIVRSITKTPGQRSAPEVYVFPPPEEESEDKRTLTCLIQNFFPEDISVQWLGDGKLISNSQHSTTTPLKSNGSNQGFFIFSRLEVAKTLWTQRKQFTCQVIHEALQKPRKLEKTISTSLGNTSLRPS

SEQ ID NO: 251 - DNA, 1572 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtctgtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 252 - protein, 516 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 253 - DNA, 1546 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtctgtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcacatctgttctcctcctactactcctcctccaccttcctgccagcccagcctgtcactgcagcggccagctcttgaggacctgctcctgggttcagatgccagcatcacatgtactctgaatggcctgagagatcctgagggagctgtcttcacctgggagccctccactgggaaggatgcagtgcagaagaaagctgtgcagaattcctgcggctgctacagtgtgtccagcgtcctgcctggctgtgctgagcgctggaacagtggcgcatcattcaagtgcacagttacccatcctgagtctgacaccttaactggcacaattgccaaagtcacagtgaacaccttcccaccccaggtccacctgctaccgccgccgtcggaggagctggccctgaatgagctcgtgtccctgacatgcctggtgcgagctttcaaccctaaagaagtgctggtgcgatggctgcatggaaatgaggagctgtccccagaaagctacctagtgtttgagcccctaaaggagccaggcgagggagccaccacctacctggtgacaagcgtgttgcgtgtatcagctgaaatctggaaacagggtgaccagtactcctgcatggtgggccacgaggccttgcccatgaacttcacccagaagaccatcgaccgtctgtcgggtaaacccaccaatgtcagcgtgtctgtgatcatgtcagagggagattgataatctagat

SEQ ID NO: 254 - protein, 507 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDHICSPPTTPPPPSCQPSLSLQRPALEDLLLGSDASITCTLNGLRDPEGAVFTWEPSTGKDAVQKKAVQNSCGCYSVSSVLPGCAERWNSGASFKCTVTHPESDTLTGTIAKVTVNTFPPQVHLLPPPSEELALNELVSLTCLVRAFNPKEVLVRWLHGNEELSPESYLVFEPLKEPGEGATTYLVTSVLRVSAEIWKQGDQYSCMVGHEALPMNFTQKTIDRLSGKPTNVSVSVIMSEGD

SEQ ID NO: 255 - DNA, 742 bp, Artificial sequence
  Description of Artificial Synthetic nucleotide sequence
gttgttgatcacatctgttctcctcctactactcctcctccaccttcctgccagcccagcctgtcactgcagcggccagctcttgaggacctgctcctgggttcagatgccagcatcacatgtactctgaatggcctgagagatcctgagggagctgtcttcacctgggagccctccactgggaaggatgcagtgcagaagaaagctgtgcagaattcctgcggctgctacagtgtgtccagcgtcctgcctggctgtgctgagcgctggaacagtggcgcatcattcaagtgcacagttacccatcctgagtctgacaccttaactggcacaattgccaaagtcacagtgaacaccttcccaccccaggtccacctgctaccgccgccgtcggaggagctggccctgaatgagctcgtgtccctgacatgcctggtgcgagctttcaaccctaaagaagtgctggtgcgatggctgcatggaaatgaggagctgtccccagaaagctacctagtgtttgagcccctaaaggagccaggcgagggagccaccacctacctggtgacaagcgtgttgcgtgtatcagctgaaatctggaaacagggtgaccagtactcctgcatggtgggccacgaggccttgcccatgaacttcacccagaagaccatcgaccgtctgtcgggtaaacccaccaatgtcagcgtgtctgtgatcatgtcagagggagattgataatctagat

SEQ ID NO: 256 - protein, 241 aa, Artificial sequence
  Description of Artificial Synthetic amino acid sequence
DHICSPPTTPPPPSCQPSLSLQRPALEDLLLGSDASITCTLNGLRDPEGAVFTWEPSTGKDAVQKKAVQNSCGCYSVSSVLPGCAERWNSGASFKCTVTHPESDTLTGTIAKVTVNTFPPQVHLLPPPSEELALNELVSLTCLVRAFNPKEVLVRWLHGNEELSPESYLVFEPLKEPGEGATTYLVTSVLRVSAEIWKQGDQYSCMVGHEALPMNFTQKTIDRLSGKPTNVSVSVIMSEGD

SEQ ID NO: 257 - DNA, 327 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgctcggtctccaacaaagccctcccagcccccatcgagaaaacaatctccaaagccaaa

SEQ ID NO: 258 - protein, 109 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCSVSNKALPAPIEKTISKAK

SEQ ID NO: 259 - DNA, 657 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgctcggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 260 - protein, 216 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCSVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - DNA, 712 bp, Artificial sequence
  Description of Artificial Synthetic nucleotide sequence
tgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcctggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 262 - protein, 234 aa, Artificial sequence
  Description of Artificial Synthetic amino acid sequence
DQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCLVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgctcggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 264 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCSVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcctggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 266 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCLVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgctcggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 268 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCSVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - DNA, 327 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcctccatcgagaaaacaatctccaaagccaaa

SEQ ID NO: 270 - protein, 109 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAK

SEQ ID NO: 271 - DNA, 657 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcctccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 272 - protein, 216 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcctccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 274 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcctccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 276 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - DNA, 327 bp, Artificial sequence
  Description of Artificial Synthetic nucleotide sequence
cctgaactcctggggggaccgtcagtcttcctcttccccccaaaacccaaggacaccctcatgatctcccggaaccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaa

SEQ ID NO: 278 - protein, 109 aa, Artificial sequence
  Description of Artificial Synthetic amino acid sequence
PELLGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 279 - DNA, 657 bp, Artificial sequence
  Description of Artificial Synthetic nucleotide sequence
cctgaactcctggggggaccgtcagtcttcctcttccccccaaaacccaaggacaccctcatgatctcccggaaccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 280 - protein, 216 aa, Artificial sequence
  Description of Artificial Synthetic amino acid sequence
PELLGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggaaccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 282 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggaaccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 284 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - DNA, 327 bp, Artificial sequence
  Description of Artificial Synthetic nucleotide sequence
cctgaactcctggggggaccgtcagtcttcctcttccccccaaaacccaaggacaccctcatgatctcccagaacgctaaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaa

SEQ ID NO: 286 - protein, 109 aa, Artificial sequence
  Description of Artificial Synthetic amino acid sequence
PELLGGPSVFLFPPKPKDTLMISQNAKVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 287 - DNA, 657 bp, Artificial sequence
  Description of Artificial Synthetic nucleotide sequence
cctgaactcctggggggaccgtcagtcttcctcttccccccaaaacccaaggacaccctcatgatctcccagaacgctaaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 288 - protein, 216 aa, Artificial sequence
  Description of Artificial Synthetic amino acid sequence
PELLGGPSVFLFPPKPKDTLMISQNAKVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccagaacgctaaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 290 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISQNAKVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccagaacgctaaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 292 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISQNAKVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - DNA, 327 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacacagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaa

SEQ ID NO: 294 - protein, 109 aa, Artificial sequence
  Description of Artificial Synthetic amino acid sequence
PELLGGPSVFLFPPKPKDTLMISRTPEVTCVVVDVSHEDPEVKFNWYVDGVEVHNAKTQPREEQYNSTYRVVSVLTVLHQDWLNGKEYKCKVSNKALPAPIEKTISKAK

SEQ ID NO: 295 - DNA, 657 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacacagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 296 - protein, 216 aa, Artificial sequence
  Description of Artificial Synthetic amino acid sequence
PELLGGPSVFLFPPKPKDTLMISRTPEVTCVVVDVSHEDPEVKFNWYVDGVEVHNAKTQPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacacagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 298 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTQPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacacagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 300 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRTPEVTCVVVDVSHEDPEVKFNWYVDGVEVHNAKTQPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - DNA, 327 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaacccaaa

SEQ ID NO: 302 - protein, 109 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKPK

SEQ ID NO: 303 - DNA, 657 bp, Artificial sequence
  Description of Artificial Synthetic nucleotide sequence
cctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaacccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 304 - protein, 216 aa, Artificial sequence
  Description of Artificial Synthetic amino acid sequence
PELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKPKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaacccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 306 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKPKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaacccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 308 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKPKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - DNA, 354 bp, Artificial sequence
  Description of Artificial Synthetic nucleotide sequence
gcggtccagctgcagcagtctggacctgagctggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcag

SEQ ID NO: 310 - protein, 118 aa, Artificial sequence
  Description of Artificial Synthetic amino acid sequence
AVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQ

SEQ ID NO: 311 - DNA, 441 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtca

SEQ ID NO: 312 - protein, 143 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSS

SEQ ID NO: 313 - DNA, 795 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagctggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcag

SEQ ID NO: 314 - protein, 261 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQ

SEQ ID NO: 315 - DNA, 354 bp, Artificial sequence
  Description of Artificial Synthetic nucleotide sequence
gcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcag

SEQ ID NO: 316 - protein, 118 aa, Artificial sequence
  Description of Artificial Synthetic amino acid sequence
AVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQ

SEQ ID NO: 317 - DNA, 795 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcag

SEQ ID NO: 318 - protein, 261 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQ

SEQ ID NO: 319 - DNA, 1506 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagctggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcatgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 320 - protein, 495 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDHDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - DNA, 1518 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagctggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 322 - protein, 499 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - DNA, 1500 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 324 - protein, 495 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDHDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - DNA, 1500 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 326 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSCDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - DNA, 1500 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttgtgacaaaactcacacatctccaccgtgctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 328 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSCDKTHTSPPCSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - DNA, 1500 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttctgacaaaactcacacatccccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 330 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - DNA, 1182 bp, Artificial sequence
  Description of Artificial Synthetic nucleotide sequence
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcaacccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 332 - protein, 393 aa, Artificial sequence
  Description of Artificial Synthetic amino acid sequence
MACLGFQRHKAQLNLAARTWPCTLLFFLLFIPVFCKAMHVAQPAVVLASSRGIASFVCEYASPGKATEVRVTVLRQADSQVTEVCAATYMTGNELTFLDDSICTGTSSGNQVNLTIQGLRAMDTGLYICKVELMYPPPYYLGIGNGTQIYVIDPEPCPDSDQPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - DNA, 465 bp, Artificial sequence
  Description of Artificial Synthetic nucleotide sequence
gttgttaagcttgccgccatggattcacaggcccaggttcttatgttactgctgctatgggtatctggtacctgtggggacattgtgatgtcacagtctccatcctccctagctgtgtcagttggagagaaggtttctatgagctgcaagtccagtcagagccttttatataatcacaatcaaaagaactacttggcctggtaccagcagataccagggcagtctcctaaactgctgatttactgggcatccactagggaatctggggtccctgatcgcttcacaggcagtggatctgggacagatttcactctcaccatcagcagagtgaaggctgaagacctggcagtttattactgtcagcaatattatacctatcctcccacgttcggaggtggcaccaagctggaaataaaaggtggcggtggctcgggcggtggtgggtcgggtggcggcgggagctcg

SEQ ID NO: 334 - protein, 149 aa, Artificial sequence
  Description of Artificial Synthetic amino acid sequence
MDSQAQVLMLLLLWVSGTCGDIVMSQSPSSLAVSVGEKVSMSCKSSQSLLYNHNQKNYLAWYQQIPGQSPKLLIYWASTRESGVPDRFTGSGSGTDFTLTISRVKAEDLAVYYCQQYYTYPPTFGGGTKLEIKGGGGSGGGGSGGGGSS

SEQ ID NO: 335 - DNA, 372 bp, Artificial sequence
  Description of Artificial Synthetic nucleotide sequence
gggagctcgcaggtgcagttgaaggagtcaggacctggcctggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcag

SEQ ID NO: 336 - protein, 124 aa, Artificial sequence
  Description of Artificial Synthetic amino acid sequence
GSSQVQLKESGPGLVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQ

SEQ ID NO: 337 - DNA, 828 bp, Artificial sequence
  Description of Artificial Synthetic nucleotide sequence
gttgttaagcttgccgccatggattcacaggcccaggttcttatgttactgctgctatgggtatctggtacctgtggggacattgtgatgtcacagtctccatcctccctagctgtgtcagttggagagaaggtttctatgagctgcaagtccagtcagagccttttatataatcacaatcaaaagaactacttggcctggtaccagcagataccagggcagtctcctaaactgctgatttactgggcatccactagggaatctggggtccctgatcgcttcacaggcagtggatctgggacagatttcactctcaccatcagcagagtgaaggctgaagacctggcagtttattactgtcagcaatattatacctatcctcccacgttcggaggtggcaccaagctggaaataaaaggtggcggtggctcgggcggtggtgggtcgggtggcggcgggagctctcaggtgcagttgaaggagtcaggacctggcctggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcag

SEQ ID NO: 338 - protein, 270 aa, Artificial sequence
  Description of Artificial Synthetic amino acid sequence
MDSQAQVLMLLLLWVSGTCGDIVMSQSPSSLAVSVGEKVSMSCKSSQSLLYNHNQKNYLAWYQQIPGQSPKLLIYWASTRESGVPDRFTGSGSGTDFTLTISRVKAEDLAVYYCQQYYTYPPTFGGGTKLEIKGGGGSGGGGSGGGGSSQVQLKESGPGLVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQ

SEQ ID NO: 339 - DNA, 372 bp, Artificial sequence
  Description of Artificial Synthetic nucleotide sequence
gggagctctcaggtgcagttgaaggagtcaggacctggctcggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcag

SEQ ID NO: 340 - protein, 124 aa, Artificial sequence
  Description of Artificial Synthetic amino acid sequence
GSSQVQLKESGPGSVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQ

SEQ ID NO: 341 - DNA, 828 bp, Artificial sequence
  Description of Artificial Synthetic nucleotide sequence
gttgttaagcttgccgccatggattcacaggcccaggttcttatgttactgctgctatgggtatctggtacctgtggggacattgtgatgtcacagtctccatcctccctagctgtgtcagttggagagaaggtttctatgagctgcaagtccagtcagagccttttatataatcacaatcaaaagaactacttggcctggtaccagcagataccagggcagtctcctaaactgctgatttactgggcatccactagggaatctggggtccctgatcgcttcacaggcagtggatctgggacagatttcactctcaccatcagcagagtgaaggctgaagacctggcagtttattactgtcagcaatattatacctatcctcccacgttcggaggtggcaccaagctggaaataaaaggtggcggtggctcgggcggtggtgggtcgggtggcggcgggagctctcaggtgcagttgaaggagtcaggacctggctcggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcag

SEQ ID NO: 342 - protein, 270 aa, Artificial sequence
  Description of Artificial Synthetic amino acid sequence
MDSQAQVLMLLLLWVSGTCGDIVMSQSPSSLAVSVGEKVSMSCKSSQSLLYNHNQKNYLAWYQQIPGQSPKLLIYWASTRESGVPDRFTGSGSGTDFTLTISRVKAEDLAVYYCQQYYTYPPTFGGGTKLEIKGGGGSGGGGSGGGGSSQVQLKESGPGSVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQ

SEQ ID NO: 343 - DNA, 1533 bp, Artificial sequence
  Description of Artificial Synthetic nucleotide sequence
gttgttaagcttgccgccatggattcacaggcccaggttcttatgttactgctgctatgggtatctggtacctgtggggacattgtgatgtcacagtctccatcctccctagctgtgtcagttggagagaaggtttctatgagctgcaagtccagtcagagccttttatataatcacaatcaaaagaactacttggcctggtaccagcagataccagggcagtctcctaaactgctgatttactgggcatccactagggaatctggggtccctgatcgcttcacaggcagtggatctgggacagatttcactctcaccatcagcagagtgaaggctgaagacctggcagtttattactgtcagcaatattatacctatcctcccacgttcggaggtggcaccaagctggaaataaaaggtggcggtggctcgggcggtggtgggtcgggtggcggcgggagctctcaggtgcagttgaaggagtcaggacctggcctggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 344 - protein, 502 aa, Artificial sequence
  Description of Artificial Synthetic amino acid sequence
MDSQAQVLMLLLLWVSGTCGDIVMSQSPSSLAVSVGEKVSMSCKSSQSLLYNHNQKNYLAWYQQIPGQSPKLLIYWASTRESGVPDRFTGSGSGTDFTLTISRVKAEDLAVYYCQQYYTYPPTFGGGTKLEIKGGGGSGGGGSGGGGSSQVQLKESGPGLVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - DNA, 1533 bp, Artificial sequence
  Description of Artificial Synthetic nucleotide sequence
gttgttaagcttgccgccatggattcacaggcccaggttcttatgttactgctgctatgggtatctggtacctgtggggacattgtgatgtcacagtctccatcctccctagctgtgtcagttggagagaaggtttctatgagctgcaagtccagtcagagccttttatataatcacaatcaaaagaactacttggcctggtaccagcagataccagggcagtctcctaaactgctgatttactgggcatccactagggaatctggggtccctgatcgcttcacaggcagtggatctgggacagatttcactctcaccatcagcagagtgaaggctgaagacctggcagtttattactgtcagcaatattatacctatcctcccacgttcggaggtggcaccaagctggaaataaaaggtggcggtggctcgggcggtggtgggtcgggtggcggcgggagctctcaggtgcagttgaaggagtcaggacctggctcggtggcgccctcacagagcctgtccatcacatgcaccgtctcagggttctcattaaccgtctatggtgttaactgggttcgccagcctccaggaaagggtctggactggctgggaatgatatggggtgatggaagcacagactataattcagctctcaaatccagactgagcatcagtaaggacaactccaagagccaagttttcttaaaaatggacagtctacaaactgatgacacagccaggtactactgtgccagagatcactatggtacccactatgctatggactactggggtcaaggaacctcagtcaccgtctcctctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 346 - protein, 502 aa, Artificial sequence
  Description of Artificial Synthetic amino acid sequence
MDSQAQVLMLLLLWVSGTCGDIVMSQSPSSLAVSVGEKVSMSCKSSQSLLYNHNQKNYLAWYQQIPGQSPKLLIYWASTRESGVPDRFTGSGSGTDFTLTISRVKAEDLAVYYCQQYYTYPPTFGGGTKLEIKGGGGSGGGGSGGGGSSQVQLKESGPGSVAPSQSLSITCTVSGFSLTVYGVNWVRQPPGKGLDWLGMIWGDGSTDYNSALKSRLSISKDNSKSQVFLKMDSLQTDDTARYYCARDHYGTHYAMDYWGQGTSVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - DNA, 399 bp, Artificial sequence
  Description of Artificial Synthetic nucleotide sequence
atgggcaggcttacttcttcattcctgctactgattgttcctgcatatgtcctctcccagattactctgaaagagtctggccctgggatcttgcagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgca

SEQ ID NO: 348 - protein, 133 aa, Artificial sequence
  Description of Artificial Synthetic amino acid sequence
MGRLTSSFLLLIVPAYVLSQITLKESGPGILQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSA

SEQ ID NO: 349 - DNA, 393 bp, Artificial sequence
  Description of Artificial Synthetic nucleotide sequence
atgaagttgcctgttaggctgttggtgctgatgttctggattcctgcttccatcagtgatgttgtgatgacccaaactccactctccctgcctgtcagtcttggagatcaggcctccatctcttgcagatctagtcagagccttctttacagtaatggaaacacctatttacattggtacctgcagaagccaggccagtctccaaaactcctgatctacaaactttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaa

SEQ ID NO: 350 - protein, 131 aa, Artificial sequence
  Description of Artificial Synthetic amino acid sequence
MKLPVRLLVLMFWIPASISDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIK

SEQ ID NO: 351 - DNA, 806 bp, Artificial sequence
  Description of Artificial Synthetic nucleotide sequence
gttgttaagcttgccgccatgaagttgcctgttaggctgttggtgctgatgttctggattcctgcttccatcagtgatgttgtgatgacccaaactccactctccctgcctgtcagtcttggagatcaggcctccatctcttgcagatctagtcagagccttctttacagtaatggaaacacctatttacattggtacctgcagaagccaggccagtctccaaaactcctgatctacaaactttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaagatggcggtggctcgggcggtggtggatctggaggaggtgggagctctcagattactctgaaagagtctggccctgggatcttgcagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgctgatca

SEQ ID NO: 352 - protein, 262 aa, Artificial sequence
  Description of Artificial Synthetic amino acid sequence
MKLPVRLLVLMFWIPASISDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIKDGGGSGGGGSGGGGSSQITLKESGPGILQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSAD

SEQ ID NO: 353 - DNA, 356 bp, Artificial sequence
  Description of Artificial Synthetic nucleotide sequence
gggagctctcagattactctgaaagagtctggccctgggatcttgcagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgctgatca

SEQ ID NO: 354 - protein, 118 aa, Artificial sequence
  Description of Artificial Synthetic amino acid sequence
GSSQITLKESGPGSSQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSAD

SEQ ID NO: 355 - DNA, 806 bp, Artificial sequence
  Description of Artificial Synthetic nucleotide sequence
gttgttaagcttgccgccatgaagttgcctgttaggctgttggtgctgatgttctggattcctgcttccatcagtgatgttgtgatgacccaaactccactctccctgcctgtcagtcttggagatcaggcctccatctcttgcagatctagtcagagccttctttacagtaatggaaacacctatttacattggtacctgcagaagccaggccagtctccaaaactcctgatctacaaactttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaagatggcggtggctcgggcggtggtggatctggaggaggtgggagctctcagattactctgaaagagtctggccctgggagctcccagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgctgatca

SEQ ID NO: 356 - protein, 262 aa, Artificial sequence
  Description of Artificial Synthetic amino acid sequence
MKLPVRLLVLMFWIPASISDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIKDGGGSGGGGSGGGGSSQITLKESGPGSSQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSAD

SEQ ID NO: 357 - DNA, 1512 bp, Artificial sequence
  Description of Artificial Synthetic nucleotide sequence
gttgttaagcttgccgccatgaagttgcctgttaggctgttggtgctgatgttctggattcctgcttccatcagtgatgttgtgatgacccaaactccactctccctgcctgtcagtcttggagatcaggcctccatctcttgcagatctagtcagagccttctttacagtaatggaaacacctatttacattggtacctgcagaagccaggccagtctccaaaactcctgatctacaaactttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaagatggcggtggctcgggcggtggtggatctggaggaggtgggagctctcagattactctgaaagagtctggccctgggatcttgcagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 358 - protein, 495 aa, Artificial sequence
  Description of Artificial Synthetic amino acid sequence
MKLPVRLLVLMFWIPASISDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIKDGGGSGGGGSGGGGSSQITLKESGPGILQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSADQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - DNA, 1513 bp, Artificial sequence
  Description of Artificial Synthetic nucleotide sequence
gttgttaagcttgccgccatgaagttgcctgttaggctgttggtgctgatgttctggattcctgcttccatcagtgatgttgtgatgacccaaactccactctccctgcctgtcagtcttggagatcaggcctccatctcttgcagatctagtcagagccttctttacagtaatggaaacacctatttacattggtacctgcagaagccaggccagtctccaaaactcctgatctacaaactttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaagatggcggtggctcgggcggtggtggatctggaggaggtgggagctctcagattactctgaaagagtctggccctgggagctcccagccctcccagaccctcagtctgacttgttctttctctgggttttcactgaccacttatggtataggagtaggttggattcgtcagcctccagggaagggtctggagtggctgacacacatttggtggaatgataataagtactataacacagccctgaggagccggctcacaatctccaaggattcctccaacaaccaagtactcctcaagatcgccaatgtggacactgcagataccgccacatactactgtctctacggctacacttactggggccaagggactctggtcactgtctctgctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagaa

SEQ ID NO: 360 - protein, 495 aa, Artificial sequence
  Description of Artificial Synthetic amino acid sequence
MKLPVRLLVLMFWIPASISDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIKDGGGSGGGGSGGGGSSQITLKESGPGSSQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSADQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - DNA, 376 bp, Artificial sequence
  Description of Artificial Synthetic nucleotide sequence
gggagctctcaggtgcagctgaagcagtcaggacctggctcagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctcag

SEQ ID NO: 362 - protein, 125 aa, Artificial sequence
  Description of Artificial Synthetic amino acid sequence
GSSQVQLKQSGPGSVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 363 - DNA, 826 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcgggagctctcaggtgcagctgaagcagtcaggacctggctcagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctcag

SEQ ID NO: 364 - protein, 271 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGSVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSS

SEQ ID NO: 365 - DNA, 1537 bp, Artificial sequence
  Description of Artificial Synthetic nucleotide sequence
aagcttgccgccatgaggttctctgctcagcttctggggctgcttgtgctctggatccctggatccactgcagatattgtgatgacgcaggctgcattctccaatccagtcactcttggaacatcagcttccatctcctgcaggtctagtaagagtctcctacatagtaatggcatcacttatttgtattggtatctgcagaagccaggccagtctcctcagctcctgatttatcagatgtccaaccttgcctcaggagtcccagacaggttcagtagcagtgggtcaggaactgatttcacactgagaatcagcagagtggaggctgaggatgtgggtgtttattactgtgctcaaaatctagaacttccgctcacgttcggtgctgggaccaagctggagctgaaacggggtggcggtggctcgggcggtggtgggtcgggtggcggcgggagctctcaggtgcagctgaagcagtcaggacctggctcagtgcagtcctcacagagcctgtccatcacctgcacagtctctggtttctcattaactacctatgctgtacactgggttcgccagtctccaggaaagggtctggagtggctgggagtgatatggagtggtggaatcacagactataatgcagctttcatatccagactgagcatcaccaaggacgattccaagagccaagttttctttaaaatgaacagtctgcaacctaatgacacagccatttattactgtgccagaaatgggggtgataactacccttattactatgctatggactactggggtcaaggaacctcagtcaccgtctcctctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagag

SEQ ID NO: 366 - protein, 505 aa, Artificial sequence
  Description of Artificial Synthetic amino acid sequence
MRFSAQLLGLLVLWIPGSTADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPLTFGAGTKLELKRGGGGSGGGGSGGGGSSQVQLKQSGPGSVQSSQSLSITCTVSGFSLTTYAVHWVRQSPGKGLEWLGVIWSGGITDYNAAFISRLSITKDDSKSQVFFKMNSLQPNDTAIYYCARNGGDNYPYYYAMDYWGQGTSVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 368 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 370 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - DNA, 1521 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatcaggagcccaaatcttgtgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 372 - protein, 500 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDQEPKSCDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 373 - DNA, 1507 bp, Artificial sequence
  Description of Artificial Synthetic nucleotide sequence
gttgttaagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttctgacaaaactcacacatgcccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagag

SEQ ID NO: 374 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSSDKTHTCPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - DNA, 1506 bp, Artificial sequence
  Description of Artificial Synthetic nucleotide sequence
gttgttaagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttgtgacaaaactcacacatgtccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 376 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSCDKTHTCPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - DNA, 1506 bp, Artificial sequence
  Description of Artificial Synthetic nucleotide sequence
gttgttaagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcaggagcccaaatcttctgacaaaactcacacatgcccaccgtgcccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 378 - protein, 493 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - DNA, 1802 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcacgttcgacctgtcaacatcactgagcccaccttggagctactccattcatcctgcgaccccaatgcattccactccaccatccagctgtactgcttcatttatggccacatcctaaatgatgtctctgtcagctggctaatggacgatcgggagataactgatacacttgcacaaactgttctaatcaaggaggaaggcaaactagcctctacctgcagtaaactcaacatcactgagcagcaatggatgtctgaaagcaccttcacctgcaaggtcacctcccaaggcgtagactatttggcccacactcggagatgcccagatcatgagccacggggtgtgattacctacctgatcccacccagccccctggacctgtatcaaaacggtgctcccaagcttacctgtctggtggtggacctggaaagcgagaagaatgtcaatgtgacgtggaaccaagagaagaagacttcagtctcagcatcccagtggtacactaagcaccacaataacgccacaactagtatcacctccatcctgcctgtagttgccaaggactggattgaaggctacggctatcagtgcatagtggaccaccctgattttcccaagcccattgtgcgttccatcaccaagaccccaggccagcgctcagcccccgaggtatatgtgttcccaccaccagaggaggagagcgaggacaaacgcacactcacctgtttgatccagaacttcttccctgaggatatctctgtgcagtggctgggggatggcaaactgatctcaaacagccagcacagtaccacaacacccctgaaatccaatggctccaatcaaggcttcttcatcttcagtcgcctagaggtcgccaagacactctggacacagagaaaacagttcacctgccaagtgatccatgaggcacttcagaaacccaggaaactggagaaaacaatatccacaagccttggtaacacctccctccgtccatcctagtaatctagagg

SEQ ID NO: 380 - protein, 592 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDHVRPVNITEPTLELLHSSCDPNAFHSTIQLYCFIYGHILNDVSVSWLMDDREITDTLAQTVLIKEEGKLASTCSKLNITEQQWMSESTFTCKVTSQGVDYLAHTRRCPDHEPRGVITYLIPPSPLDLYQNGAPKLTCLVVDLESEKNVNVTWNQEKKTSVSASQWYTKHHNNATTSITSILPVVAKDWIEGYGYQCIVDHPDFPKPIVRSITKTPGQRSAPEVYVFPPPEEESEDKRTLTCLIQNFFPEDISVQWLGDGKLISNSQHSTTTPLKSNGSNQGFFIFSRLEVAKTLWTQRKQFTCQVIHEALQKPRKLEKTISTSLGNTSLRPS

SEQ ID NO: 381 - DNA, 1525 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcacatctgttctcctcctactactcctcctccaccttcctgccagcccagcctgtcactgcagcggccagctcttgaggacctgctcctgggttcagatgccagcatcacatgtactctgaatggcctgagagatcctgagggagctgtcttcacctgggagccctccactgggaaggatgcagtgcagaagaaagctgtgcagaattcctgcggctgctacagtgtgtccagcgtcctgcctggctgtgctgagcgctggaacagtggcgcatcattcaagtgcacagttacccatcctgagtctgacaccttaactggcacaattgccaaagtcacagtgaacaccttcccaccccaggtccacctgctaccgccgccgtcggaggagctggccctgaatgagctcgtgtccctgacatgcctggtgcgagctttcaaccctaaagaagtgctggtgcgatggctgcatggaaatgaggagctgtccccagaaagctacctagtgtttgagcccctaaaggagccaggcgagggagccaccacctacctggtgacaagcgtgttgcgtgtatcagctgaaatctggaaacagggtgaccagtactcctgcatggtgggccacgaggccttgcccatgaacttcacccagaagaccatcgaccgtctgtcgggtaaacccaccaatgtcagcgtgtctgtgatcatgtcagagggagattgataatctagat

SEQ ID NO: 382 - protein, 500 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDHICSPPTTPPPPSCQPSLSLQRPALEDLLLGSDASITCTLNGLRDPEGAVFTWEPSTGKDAVQKKAVQNSCGCYSVSSVLPGCAERWNSGASFKCTVTHPESDTLTGTIAKVTVNTFPPQVHLLPPPSEELALNELVSLTCLVRAFNPKEVLVRWLHGNEELSPESYLVFEPLKEPGEGATTYLVTSVLRVSAEIWKQGDQYSCMVGHEALPMNFTQKTIDRLSGKPTNVSVSVIMSEGD

SEQ ID NO: 383 - DNA, 1782 bp, Artificial sequence
  Description of Artificial Synthetic nucleotide sequence
aagcttgccgccatggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcacgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgataatctaga

SEQ ID NO: 384 - protein, 586 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDHVCSRDFTPPTVKILQSSCDGGGHFPPTIQLLCLVSGYTPGTINITWLEDGQVMDVDLSTASTTQEGELASTQSELTLSQKHWLSDRTYTCQVTYQGHTFEDSTKKCADSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 385 - DNA, 1539 bp, Artificial sequence
  Description of Artificial Synthetic nucleotide sequence
atggtatccacagctcagttccttgggttgctgctgctgtggcttacaggtggcagatgtgacatccagatgactcagtctccagcctccctatctgcatctgtgggagagactgtcaccatcacatgtcgaacaagtgaaaatgtttacagttatttggcttggtatcagcagaaacagggaaaatctcctcagctcctggtctcttttgcaaaaaccttagcagaaggtgtgccatcaaggttcagtggcagtggatcaggcacacagttttctctgaagatcagcagcctgcagcctgaagattctggaagttatttctgtcaacatcattccgataatccgtggacgttcggtggaggcaccgaactggagatcaaaggtggcggtggctcgggcggtggtgggtcgggtggcggcggatcgtcagcggtccagctgcagcagtctggacctgagtcggaaaagcctggcgcttcagtgaagatttcctgcaaggcttctggttactcattcactggctacaatatgaactgggtgaagcagaataatggaaagagccttgagtggattggaaatattgatccttattatggtggtactacctacaaccggaagttcaagggcaaggccacattgactgtagacaaatcctccagcacagcctacatgcagctcaagagtctgacatctgaggactctgcagtctattactgtgcaagatcggtcggccctatggactactggggtcaaggaacctcagtcaccgtctcttctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 386 - protein, 296 aa, Artificial sequence
  Description of Artificial Synthetic amino acid sequence
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDQPVPSTPPTPSPSTPPTPSPSCCHPRLSLHRPALED

SEQ ID NO: 387 - DNA, 453 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcgggagctcg

SEQ ID NO: 388 - protein, 147 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSS

SEQ ID NO: 389 - DNA, 387 bp, Artificial sequence
  Description of Artificial Synthetic nucleotide sequence
gggagctcgcaggttcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcag

SEQ ID NO: 390 - protein, 129 aa, Artificial sequence
  Description of Artificial Synthetic amino acid sequence
GSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQ

SEQ ID NO: 391 - DNA, 831 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcggatcgtcacaggttcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcag

SEQ ID NO: 392 - protein, 273 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQ

SEQ ID NO: 393 - DNA, 387 bp, Artificial sequence
  Description of Artificial Synthetic nucleotide sequence
gggagctcgcaggttcagctgcagcagtctggggctgagtcggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcag

SEQ ID NO: 394 - protein, 129 aa, Artificial sequence
  Description of Artificial Synthetic amino acid sequence
GSSQVQLQQSGAESVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQ

SEQ ID NO: 395 - DNA, 831 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcgggagctcgcaggttcagctgcagcagtctggggctgagtcggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcag

SEQ ID NO: 396 - protein, 273 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAESVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQ

SEQ ID NO: 397 - DNA, 1587 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcgggagctcgcaggttcagctgcagcagtctggggctgagtcggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 398 - protein, 521 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAESVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 399 - DNA, 1536 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcggatcgtcacaggttcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcaggagcccaaatcttctgacaaaactcacacatccccaccgtcctcagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 400 - protein, 505 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - DNA, 1536 bp, Artificial sequence
  Description of Artificial Synthetic nucleotide sequence
aagcttgccgccatggagacagacacactcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggaggcaccaagctggaaatcaaaggtggcggtggctcgggcggtggtgggtcgggtggcggcgggagctcgcaggttcagctgcagcagtctggggctgagtcggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggtcaaggaacctcagtcaccgtctcctctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 402 - protein, 505 aa, Artificial sequence
  Description of Artificial Synthetic amino acid sequence
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAESVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - DNA, 438 bp, Artificial sequence
  Description of Artificial Synthetic nucleotide sequence
atggattttcaagtgcagattttcagcttcctgctaatcagtgcttcagtcataatgtccagaggacaaattgttctctcccagtctccagcaatcctgtctgcatctccaggggagaaggtcacattgacttgcagggccagctcaagtgtaagtttcatgaactggtaccagcagaagccaggatcctcccccaaaccctggatttatgccacatccaatttggcttctgagttccctggtcgcttcagtggcgagtggtctgggacctcttactctctcgcaatcagcagagtggaggctgaagatgctgccacttattactgccagcagtggaatagtaacccactcacgttcggtgctgggaccaagctggagctgaaagagctctctggtggcggtggctcgggcggtggtgggtcgggtggcggcggatct

SEQ ID NO: 404 - protein, 146 aa, Artificial sequence
  Description of Artificial Synthetic amino acid sequence
MDFQVQIFSFLLISASVIMSRGQIVLSQSPAILSASPGEKVTLTCRASSSVSFMNWYQQKPGSSPKPWIYATSNLASEFPGRFSGEWSGTSYSLAISRVEAEDAATYYCQQWNSNPLTFGAGTKLELKELSGGGGSGGGGSGGGGS

SEQ ID NO: 405 - DNA, 365 bp, Artificial sequence
  Description of Artificial Synthetic nucleotide sequence
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatca

SEQ ID NO: 406 - protein, 121 aa, Artificial sequence
  Description of Artificial Synthetic amino acid sequence
QIQLVQSGPELKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSD

SEQ ID NO: 407 - DNA, 806 bp, Artificial sequence
  Description of Artificial Synthetic nucleotide sequence
atggattttcaagtgcagattttcagcttcctgctaatcagtgcttcagtcataatgtccagaggacaaattgttctctcccagtctccagcaatcctgtctgcatctccaggggagaaggtcacattgacttgcagggccagctcaagtgtaagtttcatgaactggtaccagcagaagccaggatcctcccccaaaccctggatttatgccacatccaatttggcttctgagttccctggtcgcttcagtggcgagtggtctgggacctcttactctctcgcaatcagcagagtggaggctgaagatgctgccacttattactgccagcagtggaatagtaacccactcacgttcggtgctgggaccaagctggagctgaaagagctctctggtggcggtggctcgggcggtggtgggtcgggtggcggcggatctctgcagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatca

SEQ ID NO: 408 - protein, 268 aa, Artificial sequence
  Description of Artificial Synthetic amino acid sequence
MDFQVQIFSFLLISASVIMSRGQIVLSQSPAILSASPGEKVTLTCRASSSVSFMNWYQQKPGSSPKPWIYATSNLASEFPGRFSGEWSGTSYSLAISRVEAEDAATYYCQQWNSNPLTFGAGTKLELKELSGGGGSGGGGSGGGGSLQIQLVQSGPELKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSD

SEQ ID NO: 409 - DNA, 368 bp, Artificial sequence
  Description of Artificial Synthetic nucleotide sequence
ctgcagatccagttggtgcagtctggacctgagtcgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatca

SEQ ID NO: 410 - protein, 121 aa, Artificial sequence
  Description of Artificial Synthetic amino acid sequence
QIQLVQSGPESKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSD

SEQ ID NO: 411 - DNA, 818 bp, Artificial sequence
  Description of Artificial Synthetic nucleotide sequence
aagcttgttgttatggattttcaagtgcagattttcagcttcctgctaatcagtgcttcagtcataatgtccagaggacaaattgttctctcccagtctccagcaatcctgtctgcatctccaggggagaaggtcacattgacttgcagggccagctcaagtgtaagtttcatgaactggtaccagcagaagccaggatcctcccccaaaccctggatttatgccacatccaatttggcttctgagttccctggtcgcttcagtggcgagtggtctgggacctcttactctctcgcaatcagcagagtggaggctgaagatgctgccacttattactgccagcagtggaatagtaacccactcacgttcggtgctgggaccaagctggagctgaaagagctctctggtggcggtggctcgggcggtggtgggtcgggtggcggcggatctctgcagatccagttggtgcagtctggacctgagtcgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatca

SEQ ID NO: 412 - protein, 268 aa, Artificial sequence
  Description of Artificial Synthetic amino acid sequence
MDFQVQIFSFLLISASVIMSRGQIVLSQSPAILSASPGEKVTLTCRASSSVSFMNWYQQKPGSSPKPWIYATSNLASEFPGRFSGEWSGTSYSLAISRVEAEDAATYYCQQWNSNPLTFGAGTKLELKELSGGGGSGGGGSGGGGSLQIQLVQSGPESKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSD

SEQ ID NO: 413 - DNA, 1542 bp, Artificial sequence
  Description of Artificial Synthetic nucleotide sequence
aagcttgttgttatggattttcaagtgcagattttcagcttcctgctaatcagtgcttcagtcataatgtccagaggacaaattgttctctcccagtctccagcaatcctgtctgcatctccaggggagaaggtcacattgacttgcagggccagctcaagtgtaagtttcatgaactggtaccagcagaagccaggatcctcccccaaaccctggatttatgccacatccaatttggcttctgagttccctggtcgcttcagtggcgagtggtctgggacctcttactctctcgcaatcagcagagtggaggctgaagatgctgccacttattactgccagcagtggaatagtaacccactcacgttcggtgctgggaccaagctggagctgaaagagctctctggtggcggtggctcgggcggtggtgggtcgggtggcggcggatctctgcagatccagttggtgcagtctggacctgagtcgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatcagccagttccctcaactccacctaccccatctccctcaactccacctaccccatctccctcatgcgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 414 - protein, 507 aa, Artificial sequence
  Description of Artificial Synthetic amino acid sequence
MDFQVQIFSFLLISASVIMSRGQIVLSQSPAILSASPGEKVTLTCRASSSVSFMNWYQQKPGSSPKPWIYATSNLASEFPGRFSGEWSGTSYSLAISRVEAEDAATYYCQQWNSNPLTFGAGTKLELKELSGGGGSGGGGSGGGGSLQIQLVQSGPESKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - DNA, 1524 bp, Artificial sequence
  Description of Artificial Synthetic nucleotide sequence
aagcttgttgttatggattttcaagtgcagattttcagcttcctgctaatcagtgcttcagtcataatgtccagaggacaaattgttctctcccagtctccagcaatcctgtctgcatctccaggggagaaggtcacattgacttgcagggccagctcaagtgtaagtttcatgaactggtaccagcagaagccaggatcctcccccaaaccctggatttatgccacatccaatttggcttctgagttccctggtcgcttcagtggcgagtggtctgggacctcttactctctcgcaatcagcagagtggaggctgaagatgctgccacttattactgccagcagtggaatagtaacccactcacgttcggtgctgggaccaagctggagctgaaagagctctctggtggcggtggctcgggcggtggtgggtcgggtggcggcggatctctgcagatccagttggtgcagtctggacctgagtcgaagaagcctggagagacagtcaagatctcctgcaaggcttctgggtataccttcacaaactatggaatgaactgggtgaagcaggctccaggaaagggtttaaagtggatgggctggataaacacctacactggacagccaacatatgctgatgacttcaagggacggtttgccttctctttggaaacctctgcctacactgcctatttgcagatcaacaacctcaaaaatgaggacatggctacatatttctgtgcaagatttagctatggtaactcacgttacgctgactactggggccaaggcaccactctcacagtctcctctgatcaggagcccaaatcttctgacaaaactcacacatccccaccgtcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 416 - protein, 501 aa, Artificial sequence
  Description of Artificial Synthetic amino acid sequence
MDFQVQIFSFLLISASVIMSRGQIVLSQSPAILSASPGEKVTLTCRASSSVSFMNWYQQKPGSSPKPWIYATSNLASEFPGRFSGEWSGTSYSLAISRVEAEDAATYYCQQWNSNPLTFGAGTKLELKELSGGGGSGGGGSGGGGSLQIQLVQSGPESKKPGETVKISCKASGYTFTNYGMNWVKQAPGKGLKWMGWINTYTGQPTYADDFKGRFAFSLETSAYTAYLQINNLKNEDMATYFCARFSYGNSRYADYWGQGTTLTVSSDQEPKSSDKTHTSPPSSAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - DNA, 657 bp, Artificial sequence
  Description of Artificial Synthetic nucleotide sequence
cctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 418 - protein, 216 aa, Artificial sequence
  Description of Artificial Synthetic amino acid sequence
PELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - DNA, 712 bp, Artificial sequence
  Description of Artificial Synthetic nucleotide sequence
tgatcaggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 420 - protein, 234 aa, Artificial sequence
  Description of Artificial Synthetic amino acid sequence
DQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - DNA, 706 bp, Artificial sequence
  Description of Artificial Synthetic nucleotide sequence
ggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 422 - protein, 429 aa, Artificial sequence
  Description of Artificial Synthetic amino acid sequence
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLADQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - DNA, 1349 bp, Artificial sequence
  Description of Artificial Synthetic nucleotide sequence
aagcttgccgccatgcctgcttgtcgcctaggcccgctagccgccgccctcctcctcagcctgctgctgttcggcttcaccctagtctcaggcaccggtgcaatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggctgatcaggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagaaa

SEQ ID NO: 424 - protein, 442 aa, Artificial sequence
  Description of Artificial Synthetic amino acid sequence
MPACRLGPLAAALLLSLLLFGFTLVSGTGAMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLADQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - DNA, 1316 bp, Artificial sequence
  Description of Artificial Synthetic nucleotide sequence
gttgttaagcttgccgccatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggctgatcaggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagaaa

SEQ ID NO: 426 - protein, 429 aa, Artificial sequence
  Description of Artificial Synthetic amino acid sequence
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLADQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - DNA, 1349 bp, Artificial sequence
  Description of Artificial Synthetic nucleotide sequence
aagcttgccgccatgcctgcttgtcgcctaggcccgctagccgccgccctcctcctcagcctgctgctgttcggcttcaccctagtctcaggcaccggtgcaatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggctgatcaggagcccaaatcttctgacaaaactcacacatccccaccgtcctcagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctagaaa

SEQ ID NO: 428 - protein, 442 aa, Artificial sequence
  Description of Artificial Synthetic amino acid sequence
MPACRLGPLAAALLLSLLLFGFTLVSGTGAMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLADQEPKSSDKTHTSPPSSAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - DNA, 605 bp, Artificial sequence
  Description of Artificial Synthetic nucleotide sequence
aagcttgccgccatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggctgatcaaaa

SEQ ID NO: 430 - protein, 197 aa, Artificial sequence
  Description of Artificial Synthetic amino acid sequence
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLADQ

SEQ ID NO: 431 - DNA, 643 bp, Artificial sequence
  Description of Artificial Synthetic nucleotide sequence
aagcttgccgccatgcctgcttgtcgcctaggcccgctagccgccgccctcctcctcagcctgctgctgttcggcttcaccctagtctcaggcaccggtgcaatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggctgatcaaa

SEQ ID NO: 432 - protein, 210 aa, Artificial sequence
  Description of Artificial Synthetic amino acid sequence
MPACRLGPLAAALLLSLLLFGFTLVSGTGAMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLADQ

SEQ ID NO: 433 - DNA, 610 bp, Artificial sequence
  Description of Artificial Synthetic nucleotide sequence
gttgttaagcttgccgccatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggctgatcaaa

SEQ ID NO: 434 - protein, 197 aa, Artificial sequence
  Description of Artificial Synthetic amino acid sequence
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLADQ

SEQ ID NO: 435 - DNA, 643 bp, Artificial sequence
  Description of Artificial Synthetic nucleotide sequence
aagcttgccgccatgcctgcttgtcgcctaggcccgctagccgccgccctcctcctcagcctgctgctgttcggcttcaccctagtctcaggcaccggtgcaatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggctgatcaaa

SEQ ID NO: 436 - protein, 210 aa, Artificial sequence
  Description of Artificial Synthetic amino acid sequence
MPACRLGPLAAALLLSLLLFGFTLVSGTGAMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLADQ

SEQ ID NO: 437 - DNA, 1683 bp, Artificial sequence; identical to SEQ ID NO: 51
  Description of Artificial Synthetic nucleotide sequence

SEQ ID NO: 438 - protein, 556 aa, Artificial sequence; identical to SEQ ID NO: 52
  Description of Artificial Synthetic amino acid sequence

SEQ ID NO: 439 - DNA, 1665 bp, Artificial sequence; identical to SEQ ID NO: 53
  Description of Artificial Synthetic nucleotide sequence

SEQ ID NO: 440 - protein, 550 aa, Artificial sequence; identical to SEQ ID NO: 54
  Description of Artificial Synthetic amino acid sequence

SEQ ID NO: 441 - DNA, 1674 bp, Artificial sequence
  Description of Artificial Synthetic nucleotide sequence
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaagatggcggtggctcgggcggtggtggatctggaggaggtgggagctctcaggcttatctacagcagtctggggctgagtcggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctcttctgatctggagcccaaatcttctgacaaaactcacacatccccaccgtccccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 442 - protein, 551 aa, Artificial sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAESVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 443 - DNA, 1687 bp, Artificial sequence
  Description of Artificial Synthetic nucleotide sequence
aagcttatggattttcaagtgcagattttcagcttcctgctaatcagtgcttcagtcataatgtccagaggagtcgacatccagatgacacagactacatcctccctgtctgcctctctgggagacagagtcaccatcagttgcagggcaagtcaggacattcgcaattatttaaactggtatcagcagaaaccagatggaactgttaaactcctgatctactacacatcaagattacactcaggagtcccatcaaggttcagtggcagtgggtctggaacagattattctctcaccattgccaacctgcaaccagaagatattgccacttacttttgccaacagggtaatacgcttccgtggacgttcggtggaggcaccaaactggtaaccaaacgggagctcggtggcggtggctcgggcggtggtgggtcgggtggcggcggatctatcgatgaggtccagctgcaacagtctggacctgaactggtgaagcctggagcttcaatgtcctgcaaggcctctggttactcattcactggctacatcgtgaactggctgaagcagagccatggaaagaaccttgagtggattggacttattaatccatacaaaggtcttactacctacaaccagaaattcaagggcaaggccacattaactgtagacaagtcatccagcacagcctacatggagctcctcagtctgacatctgaagactctgcagtctattactgtgcaagatctgggtactatggtgactcggactggtacttcgatgtctggggcgcagggaccacggtcaccgtctcctctgatctggagcccaaatcttctgacaaaactcacacaagcccaccgagcccagcacctgaactcctggggggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatactcgag

SEQ ID NO: 444 - protein, 555 aa, Artificial sequence
  Description of Artificial Synthetic amino acid sequence
MDFQVQIFSFLLISASVIMSRGVDIQMTQTTSSLSASLGDRVTISCRASQDIRNYLNWYQQKPDGTVKLLIYYTSRLHSGVPSRFSGSGSGTDYSLTIANLQPEDIATYFCQQGNTLPWTFGGGTKLVTKRELGGGGSGGGGSGGGGSIDEVQLQQSGPELVKPGASMSCKASGYSFTGYIVNWLKQSHGKNLEWIGLINPYKGLTTYNQKFKGKATLTVDKSSSTAYMELLSLTSEDSAVYYCARSGYYGDSDWYFDVWGAGTTVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 445 - DNA, 1736 bp, Artificial sequence; identical to SEQ ID NO: 181
  Description of Artificial Synthetic nucleotide sequence

SEQ ID NO: 446 - protein, 573 aa, Artificial sequence; identical to SEQ ID NO: 182
  Description of Artificial Synthetic amino acid sequence

SEQ ID NO: 447 - DNA, 2166 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 448 - protein, 715 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 449 - DNA, 2166 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 450 - protein, 715 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 451 - DNA, 860 bp, Mus sp.
ggatccttcgaacatggagaacaacaaaacctcagtggattcaaaatccattaataattttgaagtaaagaccatacatgggagcaagtcagtggactctgggatctatctggacagtagttacaaaatggattatcctgaaatgggcatatgcataataattaataataagaacttccataagagcactggaatgtcatctcgctctggtacggatgtggacgcagccaacctcagagagacattcatgggcctgaaataccaagtcaggaataaaaatgatcttactcgtgaagacattttggaattaatggatagtgtttctaaggaagatcatagcaaaaggagcagctttgtgtgtgtgattctaagccatggtgatgaaggggtcatttatgggacaaatgggcctgttgaactgaaaaagttgactagcttcttcagaggcgactactgccggagtctgactggaaagccgaaactcttcatcattcaggcctgccggggtacggagctggactgtggcattgagacagacagtgggactgatgaggagatggcttgccagaagataccggtggaggctgacttcctgtatgcttactctacagcacctggttactattcctggagaaattcaaaggacgggtcgtggttcatccagtccctttgcagcatgctgaagctgtacgcgcacaagctagaatttatgcacattctcactcgcgttaacaggaaggtggcaacggaattcgagtccttctccctggactccactttccacgcaaagaaacagatcccgtgtattgtgtccatgctcacgaaagaactgtacttttatcactagctcgagatcgatg

SEQ ID NO: 452 - protein, 281 aa, Mus sp.
DPSNMENNKTSVDSKSINNFEVKTIHGSKSVDSGIYLDSSYKMDYPEMGICIIINNKNFHKSTGMSSRSGTDVDAANLRETFMGLKYQVRNKNDLTREDILELMDSVSKEDHSKRSSFVCVILSHGDEGVIYGTNGPVELKKLTSFFRGDYCRSLTGKPKLFIIQACRGTELDCGIETDSGTDEEMACQKIPVEADFLYAYSTAPGYYSWRNSKDGSWFIQSLCSMLKLYAHKLEFMHILTRVNRKVATEFESFSLDSTFHAKKQIPCIVSMLTKELYFYH

SEQ ID NO: 453 - DNA, 2383 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacaacaaaacctcagtggattcaaaatccattaataattttgaagtaaagaccatacatgggagcaagtcagtggactctgggatctatctggacagtagttacaaaatggattatcctgaaatgggcatatgcataataattaataataagaacttccataagagcactggaatgtcatctcgctctggtacggatgtggacgcagccaacctcagagagacattcatgggcctgaaataccaagtcaggaataaaaatgatcttactcgtgaagacattttggaattaatggatagtgtttctaaggaagatcatagcaaaaggagcagctttgtgtgtgtgattctaagccatggtgatgaaggggtcatttatgggacaaatgggcctgttgaactgaaaaagttgactagcttcttcagaggcgactactgccggagtctgactggaaagccgaaactcttcatcattcaggcctgccggggtacggagctggactgtggcattgagacagacagtgggactgatgaggagatggcttgccagaagataccggtggaggctgacttcctgtatgcttactctacagcacctggttactattcctggagaaattcaaaggacgggtcgtggttcatccagtccctttgcagcatgctgaagctgtacgcgcacaagctagaatttatgcacattctcactcgcgttaacaggaaggtggcaacggaattcgagtccttctccctggactccactttccacgcaaagaaacagatcccgtgtattgtgtccatgctcacgaaagaactgtacttttatcactagctcgagatcgatg

SEQ ID NO: 454 - protein, 787 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENNKTSVDSKSINNFEVKTIHGSKSVDSGIYLDSSYKMDYPEMGICIIINNKNFHKSTGMSSRSGTDVDAANLRETFMGLKYQVRNKNDLTREDILELMDSVSKEDHSKRSSFVCVILSHGDEGVIYGTNGPVELKKLTSFFRGDYCRSLTGKPKLFIIQACRGTELDCGIETDSGTDEEMACQKIPVEADFLYAYSTAPGYYSWRNSKDGSWFIQSLCSMLKLYAHKLEFMHILTRVNRKVATEFESFSLDSTFHAKKQIPCIVSMLTKELYFYH

SEQ ID NO: 455 - DNA, 2390 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaattcgaacatggagaacaacaaaacctcagtggattcaaaatccattaataattttgaagtaaagaccatacatgggagcaagtcagtggactctgggatctatctggacagtagttacaaaatggattatcctgaaatgggcatatgcataataattaataataagaacttccataagagcactggaatgtcatctcgctctggtacggatgtggacgcagccaacctcagagagacattcatgggcctgaaataccaagtcaggaataaaaatgatcttactcgtgaagacattttggaattaatggatagtgtttctaaggaagatcatagcaaaaggagcagctttgtgtgtgtgattctaagccatggtgatgaaggggtcatttatgggacaaatgggcctgttgaactgaaaaagttgactagcttcttcagaggcgactactgccggagtctgactggaaagccgaaactcttcatcattcaggcctgccggggtacggagctggactgtggcattgagacagacagtgggactgatgaggagatggcttgccagaagataccggtggaggctgacttcctgtatgcttactctacagcacctggttactattcctggagaaattcaaaggacgggtcgtggttcatccagtccctttgcagcatgctgaagctgtacgcgcacaagctagaatttatgcacattctcactcgcgttaacaggaaggtggcaacggaattcgagtccttctccctggactccactttccacgcaaagaaacagatcccgtgtattgtgtccatgctcacgaaagaactgtacttttatcactagctcgagatcgatga

SEQ ID NO: 456 - protein, 789 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNSNMENNKTSVDSKSINNFEVKTIHGSKSVDSGIYLDSSYKMDYPEMGICIIINNKNFHKSTGMSSRSGTDVDAANLRETFMGLKYQVRNKNDLTREDILELMDSVSKEDHSKRSSFVCVILSHGDEGVIYGTNGPVELKKLTSFFRGDYCRSLTGKPKLFIIQACRGTELDCGIETDSGTDEEMACQKIPVEADFLYAYSTAPGYYSWRNSKDGSWFIQSLCSMLKLYAHKLEFMHILTRVNRKVATEFESFSLDSTFHAKKQIPCIVSMLTKELYFYH

SEQ ID NO: 457 - DNA, 1466 bp, Mus sp.
ttcgaacatggatttccagagttgtctttatgctattgctgaagaactgggcagtgaagacctggctgccctcaagttcctgtgcttggactacatcccacacaagaagcaggagaccatcgaggatgcccagaagctatttctgaggctgcgggaaaaggggatgttggaggaaggcaatctgtctttcctgaaagagctgcttttccacatcagtcggtgggacctgctggtcaacttcctagactgcaaccgagaggagatggtgagagagctgcgggatccagacaatgcccagatttctccctacagggtcatgctctttaagctctcagaagaagtgagcgagttggaattgagatcttttaagttccttttgaacaatgagatccccaaatgtaagctggaagatgacttgagcctgcttgaaatttttgtagaaatggagaagaggaccatgctggcagaaaataacttggaaaccctaaaatcaatctgtgaccaggtcaacaagagcctgctggggaagatcgaggattatgaaagatcaagcacagagagaagaatgagccttgaaggaagggaagagttgccaccttcagttttggatgagatgagcctcaaaatggcggaactgtgtgactcgccaagagaacaagacagtgagtcacggacttcagacaaagtttaccaaatgaagaacaaacctcggggatactgtctgatcatcaacaatcatgatttcagcaaggcccgggaagacataacccaactccgaaaaatgaaggacagaaaaggaacagactgtgataaagaggctctgagtaagacctttaaggagcttcattttgagatagtatcttacgacgactgcactgcaaatgaaatccacgagattctagaaggctaccaaagcgcagaccacaagaacaaagactgcttcatctgctgtatcctatcccacggtgacaagggtgtcgtctatggaacggatgggaaggaggcctccatctatgacctgacatcttacttcactggttcaaagtgcccttccctgtctgggaaacccaagatctttttcattcaggcttgccaaggaagtaacttccagaaaggagtgcctgatgaggcaggcttcgagcaacagaaccacactttagaagtggattcatcatctcacaagaactatattccggatgaggcagactttctgctgggaatggctacggtgaagaactgcgtttcctaccgagatcctgtgaatggaacctggtatattcagtcactttgccagagcctgagggaaagatgtcctcaaggagatgacattcttagcatcctgactggcgtgaactatgacgtgagcaataaagacgacaggaggaacaagggaaagcagatgccacagcccaccttcacactacggaagaagctcttcttccctccctaatgactcgagatcgatt

SEQ ID NO: 458 - protein, 482 aa, Mus sp.
SNMDFQSCLYAIAEELGSEDLAALKFLCLDYIPHKKQETIEDAQKLFLRLREKGMLEEGNLSFLKELLFHISRWDLLVNFLDCNREEMVRELRDPDNAQISPYRVMLFKLSEEVSELELRSFKFLLNNEIPKCKLEDDLSLLEIFVEMEKRTMLAENNLETLKSICDQVNKSLLGKIEDYERSSTERRMSLEGREELPPSVLDEMSLKMAELCDSPREQDSESRTSDKVYQMKNKPRGYCLIINNHDFSKAREDITQLRKMKDRKGTDCDKEALSKTFKELHFEIVSYDDCTANEIHEILEGYQSADHKNKDCFICCILSHGDKGVVYGTDGKEASIYDLTSYFTGSKCPSLSGKPKIFFIQACQGSNFQKGVPDEAGFEQQNHTLEVDSSSHKNYIPDEADFLLGMATVKNCVSYRDPVNGTWYIQSLCQSLRERCPQGDDILSILTGVNYDVSNKDDRRNKGKQMPQPTFTLRKKLFFPP

SEQ ID NO: 459 - DNA, 2995 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggatttccagagttgtctttatgctattgctgaagaactgggcagtgaagacctggctgccctcaagttcctgtgcttggactacatcccacacaagaagcaggagaccatcgaggatgcccagaagctatttctgaggctgcgggaaaaggggatgttggaggaaggcaatctgtctttcctgaaagagctgcttttccacatcagtcggtgggacctgctggtcaacttcctagactgcaaccgagaggagatggtgagagagctgcgggatccagacaatgcccagatttctccctacagggtcatgctctttaagctctcagaagaagtgagcgagttggaattgagatcttttaagttccttttgaacaatgagatccccaaatgtaagctggaagatgacttgagcctgcttgaaatttttgtagaaatggagaagaggaccatgctggcagaaaataacttggaaaccctaaaatcaatctgtgaccaggtcaacaagagcctgctggggaagatcgaggattatgaaagatcaagcacagagagaagaatgagccttgaaggaagggaagagttgccaccttcagttttggatgagatgagcctcaaaatggcggaactgtgtgactcgccaagagaacaagacagtgagtcacggacttcagacaaagtttaccaaatgaagaacaaacctcggggatactgtctgatcatcaacaatcatgatttcagcaaggcccgggaagacataacccaactccgaaaaatgaaggacagaaaaggaacagactgtgataaagaggctctgagtaagacctttaaggagcttcattttgagatagtatcttacgacgactgcactgcaaatgaaatccacgagattctagaaggctaccaaagcgcagaccacaagaacaaagactgcttcatctgctgtatcctatcccacggtgacaagggtgtcgtctatggaacggatgggaaggaggcctccatctatgacctgacatcttacttcactggttcaaagtgcccttccctgtctgggaaacccaagatctttttcattcaggcttgccaaggaagtaacttccagaaaggagtgcctgatgaggcaggcttcgagcaacagaaccacactttagaagtggattcatcatctcacaagaactatattccggatgaggcagactttctgctgggaatggctacggtgaagaactgcgtttcctaccgagatcctgtgaatggaacctggtatattcagtcactttgccagagcctgagggaaagatgtcctcaaggagatgacattcttagcatcctgactggcgtgaactatgacgtgagcaataaagacgacaggaggaacaagggaaagcagatgccacagcccaccttcacactacggaagaagctcttcttccctccctaatgactcgagatcgatt

SEQ ID NO: 460 - protein, 990 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFQSCLYAIAEELGSEDLAALKFLCLDYIPHKKQETIEDAQKLFLRLREKGMLEEGNLSFLKELLFHISRWDLLVNFLDCNREEMVRELRDPDNAQISPYRVMLFKLSEEVSELELRSFKFLLNNEIPKCKLEDDLSLLEIFVEMEKRTMLAENNLETLKSICDQVNKSLLGKIEDYERSSTERRMSLEGREELPPSVLDEMSLKMAELCDSPREQDSESRTSDKVYQMKNKPRGYCLIINNHDFSKAREDITQLRKMKDRKGTDCDKEALSKTFKELHFEIVSYDDCTANEIHEILEGYQSADHKNKDCFICCILSHGDKGVVYGTDGKEASIYDLTSYFTGSKCPSLSGKPKIFFIQACQGSNFQKGVPDEAGFEQQNHTLEVDSSSHKNYIPDEADFLLGMATVKNCVSYRDPVNGTWYIQSLCQSLRERCPQGDDILSILTGVNYDVSNKDDRRNKGKQMPQPTFTLRKKLFFPP

SEQ ID NO: 461 - DNA, 2996 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggatttccagagttgtctttatgctattgctgaagaactgggcagtgaagacctggctgccctcaagttcctgtgcttggactacatcccacacaagaagcaggagaccatcgaggatgcccagaagctatttctgaggctgcgggaaaaggggatgttggaggaaggcaatctgtctttcctgaaagagctgcttttccacatcagtcggtgggacctgctggtcaacttcctagactgcaaccgagaggagatggtgagagagctgcgggatccagacaatgcccagatttctccctacagggtcatgctctttaagctctcagaagaagtgagcgagttggaattgagatcttttaagttccttttgaacaatgagatccccaaatgtaagctggaagatgacttgagcctgcttgaaatttttgtagaaatggagaagaggaccatgctggcagaaaataacttggaaaccctaaaatcaatctgtgaccaggtcaacaagagcctgctggggaagatcgaggattatgaaagatcaagcacagagagaagaatgagccttgaaggaagggaagagttgccaccttcagttttggatgagatgagcctcaaaatggcggaactgtgtgactcgccaagagaacaagacagtgagtcacggacttcagacaaagtttaccaaatgaagaacaaacctcggggatactgtctgatcatcaacaatcatgatttcagcaaggcccgggaagacataacccaactccgaaaaatgaaggacagaaaaggaacagactgtgataaagaggctctgagtaagacctttaaggagcttcattttgagatagtatcttacgacgactgcactgcaaatgaaatccacgagattctagaaggctaccaaagcgcagaccacaagaacaaagactgcttcatctgctgtatcctatcccacggtgacaagggtgtcgtctatggaacggatgggaaggaggcctccatctatgacctgacatcttacttcactggttcaaagtgcccttccctgtctgggaaacccaagatctttttcattcaggcttgccaaggaagtaacttccagaaaggagtgcctgatgaggcaggcttcgagcaacagaaccacactttagaagtggattcatcatctcacaagaactatattccggatgaggcagactttctgctgggaatggctacggtgaagaactgcgtttcctaccgagatcctgtgaatggaacctggtatattcagtcactttgccagagcctgagggaaagatgtcctcaaggagatgacattcttagcatcctgactggcgtgaactatgacgtgagcaataaagacgacaggaggaacaagggaaagcagatgccacagcccaccttcacactacggaagaagctcttcttccctccctaatgactcgagatcgattc

SEQ ID NO: 462 - protein, 990 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFQSCLYAIAEELGSEDLAALKFLCLDYIPHKKQETIEDAQKLFLRLREKGMLEEGNLSFLKELLFHISRWDLLVNFLDCNREEMVRELRDPDNAQISPYRVMLFKLSEEVSELELRSFKFLLNNEIPKCKLEDDLSLLEIFVEMEKRTMLAENNLETLKSICDQVNKSLLGKIEDYERSSTERRMSLEGREELPPSVLDEMSLKMAELCDSPREQDSESRTSDKVYQMKNKPRGYCLIINNHDFSKAREDITQLRKMKDRKGTDCDKEALSKTFKELHFEIVSYDDCTANEIHEILEGYQSADHKNKDCFICCILSHGDKGVVYGTDGKEASIYDLTSYFTGSKCPSLSGKPKIFFIQACQGSNFQKGVPDEAGFEQQNHTLEVDSSSHKNYIPDEADFLLGMATVKNCVSYRDPVNGTWYIQSLCQSLRERCPQGDDILSILTGVNYDVSNKDDRRNKGKQMPQPTFTLRKKLFFPP

SEQ ID NO: 463 - DNA, 860 bp, Homo sapiens
ggatccttcgaacatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaactcgagatcgata

SEQ ID NO: 464 - protein, 281 aa, Homo sapiens
DPSNMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 465 - DNA, 2383 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaactcgagatcgata

SEQ ID NO: 466 - protein, 787 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 467 - DNA, 2384 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaactcgagatcgataa

SEQ ID NO: 468 - protein, 787 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 469 - DNA, 1466 bp, Homo sapiens
ggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgata

SEQ ID NO: 470 - protein, 483 aa, Homo sapiens
DPSNMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 471 - DNA, 1421 bp, Homo sapiens
ggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgata

SEQ ID NO: 472 - protein, 468 aa, Homo sapiens
DPSNMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 473 - DNA, 2989 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgata

SEQ ID NO: 474 - protein, 989 aa, Artificial sequence [sequence omitted]

SEQ ID NO: 475 - DNA, 2990 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgataa

SEQ ID NO: 476 - protein, 989 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 477 - DNA, 2178 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgataactcgagatcgataacaac

SEQ ID NO: 478 - protein, 716 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 479 - DNA, 2178 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaggaaggttccttggacgttcggtggaggcaccaagctggaaatcaaacggggtggcggtggctcgggcggaggtgggtcgggtggcggcggatctcaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcaccaaggacaactccaagagccaagttttcttaaaaatgaacagtctgcaaactgatgacacagccagatactactgtgccagagatggttatagtaactttcattactatgttatggactactggggtcaaggaacctcagtcaccgtctcctcagatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgataactcgagatcgataacaac

SEQ ID NO: 480 - protein, 716 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSRKVPWTFGGGTKLEIKRGGGGSGGGGSGGGGSQVQLKESGPGLVAPSQSLSITCTVSGFSLTGYGVNWVRQPPGKGLEWLGMIWGDGSTDYNSALKSRLSITKDNSKSQVFLKMNSLQTDDTARYYCARDGYSNFHYYVMDYWGQGTSVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 481 - DNA, 2004 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcacccaatctccagcttctttggctgtgtctctaggtcagagagccaccatctcctgcagagccagtgaaagtgttgaatattatgtcacaagtttaatgcagtggtaccaacagaaaccaggacagccacccaaactcctcatctctgctgcatccaacgtagaatctggggtccctgccaggtttagtggcagtgggtctgggacagacttcagcctcaacatccatcctgtggaggaggatgatattgcaatgtatttctgtcagcaaagtaagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 482 - protein, 663 aa, Artificial sequence
  Description of Artificial Synthetic amino acid sequence
MDFQVQIFSFLLISASVIMSRGVDIVLTQSPASLAVSLGQRATISCRASESVEYYVTSLMQWYQQKPGQPPKLLISAASNVESGVPARFSGSGSGTDFSLNIHPVEEDDIAMYFCQQSKLMDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 483 - DNA, 1668 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatcacatctgttctcctcctactactcctcctccaccttcctgccagcccagcctgtcactgcagcggccagctcttgaggacctgctcctgggttcagatgccagcatcacatgtactctgaatggcctgagagatcctgagggagctgtcttcacctgggagccctccactgggaaggatgcagtgcagaagaaagctgtgcagaattcctgcggctgctacagtgtgtccagcgtcctgcctggctgtgctgagcgctggaacagtggcgcatcattcaagtgcacagttacccatcctgagtctgacaccttaactggcacaattgccaaagtcacagtgaacaccttcccaccccaggtccacctgctaccgccgccgtcggaggagctggccctgaatgagctcgtgtccctgacatgcctggtgcgagctttcaaccctaaagaagtgctggtgcgatggctgcatggaaatgaggagctgtccccagaaagctacctagtgtttgagcccctaaaggagccaggcgagggagccaccacctacctggtgacaagcgtgttgcgtgtatcagctgaaatctggaaacagggtgaccagtactcctgcatggtgggccacgaggccttgcccatgaacttcacccagaagaccatcgaccgtctgtcgggtaaacccaccaatgtcagcgtgtctgtgatcatgtcagagggagaggatccttcgaacaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgatact

SEQ ID NO: 484 - protein, 550 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDHICSPPTTPPPPSCQPSLSLQRPALEDLLLGSDASITCTLNGLRDPEGAVFTWEPSTGKDAVQKKAVQNSCGCYSVSSVLPGCAERWNSGASFKCTVTHPESDTLTGTIAKVTVNTFPPQVHLLPPPSEELALNELVSLTCLVRAFNPKEVLVRWLHGNEELSPESYLVFEPLKEPGEGATTYLVTSVLRVSAEIWKQGDQYSCMVGHEALPMNFTQKTIDRLSGKPTNVSVSVIMSEGEDPSNNLLPSWAITLISVNGIFVICCLTYCFAPRCRERRRNERLRRESVRPV

SEQ ID NO: 485 - DNA, 2127 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 486 - protein, 702 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 487 - DNA, 2127 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacccattcctggtgctgctgcactcgctgtccggcagcctgtcgggcaacgatctgatggagctcaagttcttgtgccgcgagcgcgtgagcaaacgaaagctggagcgcgtgcagagtggcctggacctgttcacggtgctgctggagcagaacgacctggagcgcgggcacaccgggctgctgcgcgagttgctggcctcgctgcgccgacacgatctactgcagcgcctggacgacttcgaggcggggacggcgaccgctgcgcccccgggggaggcagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggtcaaggcgctgcggacctgcaggctgaatctggtggctgacctggtggaagaagcccaggaatctgtgagcaagagtgagaatatgtccccagtactaagggattcaactgtgtcttcctcagaaacaccctgactcgagatcgat

SEQ ID NO: 488 - protein, 702 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDPFLVLLHSLSGSLSGNDLMELKFLCRERVSKRKLERVQSGLDLFTVLLEQNDLERGHTGLLRELLASLRRHDLLQRLDDFEAGTATAAPPGEADLQVAFDIVCDNVGRDWKRLARELKVSEAKMDGIEEKYPRSLSERVRESLKVWKNAEKKNASVAGLVKALRTCRLNLVADLVEEAQESVSKSENMSPVLRDSTVSSSETP

SEQ ID NO: 489 - DNA, 2344 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacaacaaaacctcagtggattcaaaatccattaataattttgaagtaaagaccatacatgggagcaagtcagtggactctgggatctatctggacagtagttacaaaatggattatcctgaaatgggcatatgcataataattaataataagaacttccataagagcactggaatgtcatctcgctctggtacggatgtggacgcagccaacctcagagagacattcatgggcctgaaataccaagtcaggaataaaaatgatcttactcgtgaagacattttggaattaatggatagtgtttctaaggaagatcatagcaaaaggagcagctttgtgtgtgtgattctaagccatggtgatgaaggggtcatttatgggacaaatgggcctgttgaactgaaaaagttgactagcttcttcagaggcgactactgccggagtctgactggaaagccgaaactcttcatcattcaggcctgccggggtacggagctggactgtggcattgagacagacagtgggactgatgaggagatggcttgccagaagataccggtggaggctgacttcctgtatgcttactctacagcacctggttactattcctggagaaattcaaaggacgggtcgtggttcatccagtccctttgcagcatgctgaagctgtacgcgcacaagctagaatttatgcacattctcactcgcgttaacaggaaggtggcaacggaattcgagtccttctccctggactccactttccacgcaaagaaacagatcccgtgtattgtgtccatgctcacgaaagaactgtacttttatcactagctcgagatcgatg

SEQ ID NO: 490 - protein, 774 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENNKTSVDSKSINNFEVKTIHGSKSVDSGIYLDSSYKMDYPEMGICIIINNKNFHKSTGMSSRSGTDVDAANLRETFMGLKYQVRNKNDLTREDILELMDSVSKEDHSKRSSFVCVILSHGDEGVIYGTNGPVELKKLTSFFRGDYCRSLTGKPKLFIIQACRGTELDCGIETDSGTDEEMACQKIPVEADFLYAYSTAPGYYSWRNSKDGSWFIQSLCSMLKLYAHKLEFMHILTRVNRKVATEFESFSLDSTFHAKKQIPCIVSMLTKELYFYH

SEQ ID NO: 491 - DNA, 782 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctga

SEQ ID NO: 492 - protein, 776 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNSNMENNKTSVDSKSINNFEVKTIHGSKSVDSGIYLDSSYKMDYPEMGICIIINNKNFHKSTGMSSRSGTDVDAANLRETFMGLKYQVRNKNDLTREDILELMDSVSKEDHSKRSSFVCVILSHGDEGVIYGTNGPVELKKLTSFFRGDYCRSLTGKPKLFIIQACRGTELDCGIETDSGTDEEMACQKIPVEADFLYAYSTAPGYYSWRNSKDGSWFIQSLCSMLKLYAHKLEFMHILTRVNRKVATEFESFSLDSTFHAKKQIPCIVSMLTKELYFYH

SEQ ID NO: 493 - DNA, 2956 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggatttccagagttgtctttatgctattgctgaagaactgggcagtgaagacctggctgccctcaagttcctgtgcttggactacatcccacacaagaagcaggagaccatcgaggatgcccagaagctatttctgaggctgcgggaaaaggggatgttggaggaaggcaatctgtctttcctgaaagagctgcttttccacatcagtcggtgggacctgctggtcaacttcctagactgcaaccgagaggagatggtgagagagctgcgggatccagacaatgcccagatttctccctacagggtcatgctctttaagctctcagaagaagtgagcgagttggaattgagatcttttaagttccttttgaacaatgagatccccaaatgtaagctggaagatgacttgagcctgcttgaaatttttgtagaaatggagaagaggaccatgctggcagaaaataacttggaaaccctaaaatcaatctgtgaccaggtcaacaagagcctgctggggaagatcgaggattatgaaagatcaagcacagagagaagaatgagccttgaaggaagggaagagttgccaccttcagttttggatgagatgagcctcaaaatggcggaactgtgtgactcgccaagagaacaagacagtgagtcacggacttcagacaaagtttaccaaatgaagaacaaacctcggggatactgtctgatcatcaacaatcatgatttcagcaaggcccgggaagacataacccaactccgaaaaatgaaggacagaaaaggaacagactgtgataaagaggctctgagtaagacctttaaggagcttcattttgagatagtatcttacgacgactgcactgcaaatgaaatccacgagattctagaaggctaccaaagcgcagaccacaagaacaaagactgcttcatctgctgtatcctatcccacggtgacaagggtgtcgtctatggaacggatgggaaggaggcctccatctatgacctgacatcttacttcactggttcaaagtgcccttccctgtctgggaaacccaagatctttttcattcaggcttgccaaggaagtaacttccagaaaggagtgcctgatgaggcaggcttcgagcaacagaaccacactttagaagtggattcatcatctcacaagaactatattccggatgaggcagactttctgctgggaatggctacggtgaagaactgcgtttcctaccgagatcctgtgaatggaacctggtatattcagtcactttgccagagcctgagggaaagatgtcctcaaggagatgacattcttagcatcctgactggcgtgaactatgacgtgagcaataaagacgacaggaggaacaagggaaagcagatgccacagcccaccttcacactacggaagaagctcttcttccctccctaatgactcgagatcgatt

SEQ ID NO: 494 - protein, 977 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFQSCLYAIAEELGSEDLAALKFLCLDYIPHKKQETIEDAQKLFLRLREKGMLEEGNLSFLKELLFHISRWDLLVNFLDCNREEMVRELRDPDNAQISPYRVMLFKLSEEVSELELRSFKFLLNNEIPKCKLEDDLSLLEIFVEMEKRTMLAENNLETLKSICDQVNKSLLGKIEDYERSSTERRMSLEGREELPPSVLDEMSLKMAELCDSPREQDSESRTSDKVYQMKNKPRGYCLIINNHDFSKAREDITQLRKMKDRKGTDCDKEALSKTFKELHFEIVSYDDCTANEIHEILEGYQSADHKNKDCFICCILSHGDKGVVYGTDGKEASIYDLTSYFTGSKCPSLSGKPKIFFIQACQGSNFQKGVPDEAGFEQQNHTLEVDSSSHKNYIPDEADFLLGMATVKNCVSYRDPVNGTWYIQSLCQSLRERCPQGDDILSILTGVNYDVSNKDDRRNKGKQMPQPTFTLRKKLFFPP

SEQ ID NO: 495 - DNA, 2957 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggatttccagagttgtctttatgctattgctgaagaactgggcagtgaagacctggctgccctcaagttcctgtgcttggactacatcccacacaagaagcaggagaccatcgaggatgcccagaagctatttctgaggctgcgggaaaaggggatgttggaggaaggcaatctgtctttcctgaaagagctgcttttccacatcagtcggtgggacctgctggtcaacttcctagactgcaaccgagaggagatggtgagagagctgcgggatccagacaatgcccagatttctccctacagggtcatgctctttaagctctcagaagaagtgagcgagttggaattgagatcttttaagttccttttgaacaatgagatccccaaatgtaagctggaagatgacttgagcctgcttgaaatttttgtagaaatggagaagaggaccatgctggcagaaaataacttggaaaccctaaaatcaatctgtgaccaggtcaacaagagcctgctggggaagatcgaggattatgaaagatcaagcacagagagaagaatgagccttgaaggaagggaagagttgccaccttcagttttggatgagatgagcctcaaaatggcggaactgtgtgactcgccaagagaacaagacagtgagtcacggacttcagacaaagtttaccaaatgaagaacaaacctcggggatactgtctgatcatcaacaatcatgatttcagcaaggcccgggaagacataacccaactccgaaaaatgaaggacagaaaaggaacagactgtgataaagaggctctgagtaagacctttaaggagcttcattttgagatagtatcttacgacgactgcactgcaaatgaaatccacgagattctagaaggctaccaaagcgcagaccacaagaacaaagactgcttcatctgctgtatcctatcccacggtgacaagggtgtcgtctatggaacggatgggaaggaggcctccatctatgacctgacatcttacttcactggttcaaagtgcccttccctgtctgggaaacccaagatctttttcattcaggcttgccaaggaagtaacttccagaaaggagtgcctgatgaggcaggcttcgagcaacagaaccacactttagaagtggattcatcatctcacaagaactatattccggatgaggcagactttctgctgggaatggctacggtgaagaactgcgtttcctaccgagatcctgtgaatggaacctggtatattcagtcactttgccagagcctgagggaaagatgtcctcaaggagatgacattcttagcatcctgactggcgtgaactatgacgtgagcaataaagacgacaggaggaacaagggaaagcagatgccacagcccaccttcacactacggaagaagctcttcttccctccctaatgactcgagatcgattc

SEQ ID NO: 496 - protein, 977 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFQSCLYAIAEELGSEDLAALKFLCLDYIPHKKQETIEDAQKLFLRLREKGMLEEGNLSFLKELLFHISRWDLLVNFLDCNREEMVRELRDPDNAQISPYRVMLFKLSEEVSELELRSFKFLLNNEIPKCKLEDDLSLLEIFVEMEKRTMLAENNLETLKSICDQVNKSLLGKIEDYERSSTERRMSLEGREELPPSVLDEMSLKMAELCDSPREQDSESRTSDKVYQMKNKPRGYCLIINNHDFSKAREDITQLRKMKDRKGTDCDKEALSKTFKELHFEIVSYDDCTANEIHEILEGYQSADHKNKDCFICCILSHGDKGVVYGTDGKEASIYDLTSYFTGSKCPSLSGKPKIFFIQACQGSNFQKGVPDEAGFEQQNHTLEVDSSSHKNYIPDEADFLLGMATVKNCVSYRDPVNGTWYIQSLCQSLRERCPQGDDILSILTGVNYDVSNKDDRRNKGKQMPQPTFTLRKKLFFPP

SEQ ID NO: 497 - DNA, 2344 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaactcgagatcgata

SEQ ID NO: 498 - protein, 774 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 499 - DNA, 2345 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaactcgagatcgataa

SEQ ID NO: 500 - protein, 774 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 501 - DNA, 2950 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgata

SEQ ID NO: 502 - protein, 976 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 503 - DNA, 2951 bp, Artificial sequence
  Description of Artificial Synthetic nucleotide sequence
aagcttatggattttcaagtgcagattttcagcttcctgctaatcagtgcttcagtcataatgtccagaggagtcgacattgtgctcactcagtctccaacaaccatagctgcatctccaggggagaaggtcaccatcacctgccgtgccagctccagtgtaagttacatgtactggtaccagcagaagtcaggcgcctcccctaaactctggatttatgacacatccaagctggcttctggagttccaaatcgcttcagtggcagtgggtctgggacctcttattctctcgcaatcaacaccatggagactgaagatgctgccacttattactgtcagcagtggagtagtactccgctcacgttcgggtctgggaccaagctggagatcaaacggggtggcggtggctcgggcggtggtgggtcgggtggcggcggatctcaggtgcagctgaaggaggcaggacctggcctggtgcaaccgacacagaccctgtccctcacatgcactgtctctgggttctcattaaccagcgatggtgtacactggattcgacagcctccaggaaagggtctggaatggatgggaataatatattatgatggaggcacagattataattcagcaattaaatccagactgagcatcagcagggacacctccaagagccaagttttcttaaaaatcaacagtctgcaaactgatgacacagccatgtattactgtgccagaatccactttgattactggggccaaggagtcatggtcacagtctcctctgatctggagcccaaatcttctgacaaaactcacacatccccaccgtccccagcacctgaactcctgggtggatcgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgagcatgcatcgataa

SEQ ID NO: 504 - protein, 976 aa, Artificial sequence
  Description of Artificial Synthetic amino acid sequence
MDFQVQIFSFLLISASVIMSRGVDIVLTQSPTTIAASPGEKVTITCRASSSVSYMYWYQQKSGASPKLWIYDTSKLASGVPNRFSGSGSGTSYSLAINTMETEDAATYYCQQWSSTPLTFGSGTKLEIKRGGGGSGGGGSGGGGSQVQLKEAGPGLVQPTQTLSLTCTVSGFSLTSDGVHWIRQPPGKGLEWMGIIYYDGGTDYNSAIKSRLSISRDTSKSQVFLKINSLQTDDTAMYYCARIHFDYWGQGVMVTVSSDLEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 505 - DNA, 1254 bp, Artificial sequence
  Description of Artificial Synthetic nucleotide sequence
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgataatctaga

SEQ ID NO: 506 - protein, 414 aa, Artificial sequence [sequence omitted]

SEQ ID NO: 507 - DNA, 1242 bp, Artificial sequence
  Description of Artificial Synthetic nucleotide sequence
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgacggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggactgataatctaga

SEQ ID NO: 508 - protein, 410 aa, Artificial sequence
  Description of Artificial Synthetic amino acid sequence
MACLGFQRHKAQLNLAARTWPCTLLFFLLFIPVFCKAMHVAQPAVVLASSRGIASFVCEYASPGKATEVRVTVLRQADSQVTEVCAATYMTGNELTFLDDSICTGTSSGNQVNLTIQGLRAMDTGLYICKVELMYPPPYYLGIGNGTQIYVIDPEPCPDSDQPVPSTPPTPSPSTPPTPSPSCCHPRLSLHRPALEDLLLGSEAILTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVD

SEQ ID NO: 509 - DNA, 721 bp, Artificial sequence
  Description of Artificial Synthetic nucleotide sequence
tgatcagccagttccctcaactccacctaccccatctccctcaactccacctaccccatctccctcatgctgccacccccgactgtcactgcaccgaccggccctcgaggacctgctcttaggttcagaagcgatcctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaatgataatctaga

SEQ ID NO: 510 - protein, 236 aa, Artificial sequence; identical to SEQ ID NO: 74
  Description of Artificial Synthetic amino acid sequence

SEQ ID NO: 511 - DNA, 1680 bp, Artificial sequence
  Description of Artificial Synthetic nucleotide sequence
aagcttatggattttcaagtgcagattttcagcttcctgctaatcagtgcttcagtcataatgtccagaggagtcgacatccagatgacacagactacatcctccctgtctgcctctctgggagacagagtcaccatcagttgcagggcaagtcaggacattcgcaattatttaaactggtatcagcagaaaccagatggaactgttaaactcctgatctactacacatcaagattacactcaggagtcccatcaaggttcagtggcagtgggtctggaacagattattctctcaccattgccaacctgcaaccagaagatattgccacttacttttgccaacagggtaatacgcttccgtggacgttcggtggaggcaccaaactggtaaccaaacgggagctcggtggcggtggctcgggcggtggtgggtcgggtggcggcggatctatcgatgaggtccagctgcaacagtctggacctgaactggtgaagcctggagcttcaatgtcctgcaaggcctctggttactcattcactggctacatcgtgaactggctgaagcagagccatggaaagaaccttgagtggattggacttattaatccatacaaaggtcttactacctacaaccagaaattcaagggcaaggccacattaactgtagacaagtcatccagcacagcctacatggagctcctcagtctgacatctgaagactctgcagtctattactgtgcaagatctgggtactatggtgactcggactggtacttcgatgtctggggcgcagggaccacggtcaccgtctcctctgatctggagcccaaatcttctgacaaaactcacacatccccaccgtccccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagcggatccttcgaacctgctcccatcctgggccattaccttaatctcagtaaatggaatttttgtgatatgctgcctgacctactgctttgccccaagatgcagagagagaaggaggaatgagagattgagaagggaaagtgtacgccctgtataaatcgat

SEQ ID NO: 512 - protein, 555 aa, Artificial sequence
  Description of Artificial Synthetic amino acid sequence
MDFQVQIFSFLLISASVIMSRGVDIQMTQTTSSLSASLGDRVTISCRASQDIRNYLNWYQQKPDGTVKLLIYYTSRLHSGVPSRFSGSGSGTDYSLTIANLQPEDIATYFCQQGNTLPWTFGGGTKLVTKRELGGGGSGGGGSGGGGSIDEVQLQQSGPELVKPGASMSCKASGYSFTGYIVNWLKQSHGKNLEWIGLINPYKGLTTYNQKFKGKATLTVDKSSSTAYMELLSLTSEDSAVYYCARSGYYGDSDWYFDVWGAGTTVTVSSDLEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKADPSNLLPSWAITLISVNGIFVICCLTYCFAPRCRERRRNERLRRESVRPV

SEQ ID NO: 513 - DNA, 780 bp, Artificial sequence
  Description of Artificial Synthetic nucleotide sequence
aagcttgccgccatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgaccc

SEQ ID NO: 514 - protein, 254 aa, Artificial sequence
  Description of Artificial Synthetic amino acid sequence
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQVSFCLVMVLLFAVDTGLYFSVKTNIRSSTRDWKDHKFKWRKDPQDK

SEQ ID NO: 515 - protein, 4 aa, Homo sapiens
CPPC

SEQ ID NO: 516 - protein, 5 aa, Artificial Sequence
  Description of Artificial Synthetic linker peptide
GGGGS

SEQ ID NO: 517 - DNA, 36 bp, Artificial Sequence
  Description of Artificial Synthetic primer
gttgtcgactgcaccggtctttgtctctctctcttc

SEQ ID NO: 518 - DNA, 48 bp, Artificial Sequence
  Description of Artificial Synthetic primer
gttgtggatccttcgaaccccttttgggtgctggtggtggttggtgga

SEQ ID NO: 519 - DNA, 42 bp, Artificial Sequence
  Description of Artificial Synthetic primer
gttgttatcgatctcgagtcaggagcgataggctgcgaagtc

SEQ ID NO: 520-527 - skipped (8 entries)

SEQ ID NO: 528 - protein, 4 aa, Artificial Sequence
  Description of Artificial Synthetic peptide
YVAD

SEQ ID NO: 529 - protein, 15 aa, Artificial Sequence
  Description of Artificial Synthetic linker peptide
GGGGSGGGGSGGGGS

SEQ ID NO: 530 - DNA, 43 bp, Artificial Sequence
  Description of Artificial Synthetic primer
gtcaagcttgccgccatggattttcaagtgcagatttttcagc

SEQ ID NO: 531 - DNA, 74 bp, Artificial Sequence
  Description of Artificial Synthetic primer
gtcgtcgagctcccacctcctccagatccaccaccgcccgagccaccgccacctttcagctccagcttggtccc

SEQ ID NO: 532 - DNA, 37 bp, Artificial Sequence
  Description of Artificial Synthetic primer
gctgctgagctctcaggcttatctacagcaagtctgg

SEQ ID NO: 533 - DNA, 32 bp, Artificial Sequence
  Description of Artificial Synthetic primer
gttgtctgatcagagacggtgaccgtggtccc

SEQ ID NO: 534 - DNA, 36 bp, Artificial Sequence
  Description of Artificial Synthetic primer
gtggatccaggttcgaagtctccaaaggcacaggcc

SEQ ID NO: 535 - DNA, 34 bp, Artificial Sequence
  Description of Artificial Synthetic primer
gttgtcggatccagaaaacagctttgaaatgcaa

SEQ ID NO: 536 - DNA, 44 bp, Artificial Sequence
  Description of Artificial Synthetic primer
gttgtttctagattatcactcgagtttgagtaagccaaaggacg

SEQ ID NO: 537 - DNA, 35 bp, Artificial Sequence
  Description of Artificial Synthetic primer
gttgtcggatccaagaaggttggacaagatagaag

SEQ ID NO: 538 - DNA, 44 bp, Artificial Sequence; identical to SEQ ID NO: 536
  Description of Artificial Synthetic primer

SEQ ID NO: 539 - DNA, 23 bp, Artificial Sequence
  Description of Artificial Synthetic primer
gtctatataagcagagctctggc

SEQ ID NO: 540 - DNA, 25 bp, Artificial Sequence
  Description of Artificial Synthetic primer
cgaggctgatcagcgagctctagca

SEQ ID NO: 541 - DNA, 25 bp, Artificial Sequence
  Description of Artificial Synthetic primer
ccgcaatttgaggattctgatcacc

SEQ ID NO: 542 - DNA, 35 bp, Artificial Sequence
  Description of Artificial Synthetic primer
gttgttgatcaagaaccacatggaggatgcacgtg

SEQ ID NO: 543 - DNA, 32 bp, Artificial Sequence
  Description of Artificial Synthetic primer
gttgttgatcaagaacccaagacaccaaaacc

SEQ ID NO: 544 - DNA, 33 bp, Artificial Sequence
  Description of Artificial Synthetic primer
gttgttgatcaagcgcaccacagcgaagacccc

SEQ ID NO: 545 - DNA, 42 bp, Artificial Sequence
  Description of Artificial Synthetic primer
gttgtttctagattactatttacccgaagactgggtgatgga

SEQ ID NO: 546 - DNA, 19 bp, Artificial Sequence
  Description of Artificial Synthetic primer
ctgagatcgagttcagctg

SEQ ID NO: 547 - DNA, 19 bp, Artificial Sequence
  Description of Artificial Synthetic primer
cctcctttggctttgtctc

SEQ ID NO: 548 - DNA, 64 bp, Artificial Sequence
  Description of Artificial Synthetic primer
gttgttgatcaggagcccaaatcttctgacaaaactcacacatctccaccgtgcccagcacctg

SEQ ID NO: 549 - DNA, 51 bp, Artificial Sequence
  Description of Artificial Synthetic primer
gttgttgatcaggagcccaaatcttctgacaaaactcacacatgcccaccg

SEQ ID NO: 550 - DNA, 39 bp, Artificial Sequence
  Description of Artificial Synthetic primer
gttgttgatcaggagcccaaatcttgtgacaaaactcac

SEQ ID NO: 551 - DNA, 52 bp, Artificial Sequence
  Description of Artificial Synthetic primer
gttgtttctagatcatttacccggagacagggagaggctcttctgcgtgtag

SEQ ID NO: 552 - DNA, 56 bp, Artificial Sequence
  Description of Artificial Synthetic primer
ggaggtgggagctctcaggcttatctacagcagtctggggctgagtcggtgaggcc

SEQ ID NO: 553 - DNA, 30 bp, Artificial Sequence
  Description of Artificial Synthetic primer
gtctctagactatcatttacccggagacag

SEQ ID NO: 554 - DNA, 54 bp, Artificial Sequence
  Description of Artificial Synthetic primer
ccatctccctcaactccacctaccccatctccctcatgcgcacctgaactcctg

SEQ ID NO: 555 - DNA, 50 bp, Artificial Sequence
  Description of Artificial Synthetic primer
gttgttgatcagccagttccctcaactccacctaccccatctccccaact

SEQ ID NO: 556 - DNA, 30 bp, Artificial Sequence; identical to SEQ ID NO: 553
  Description of Artificial Synthetic primer

SEQ ID NO: 557 - DNA, 51 bp, Artificial Sequence
  Description of Artificial Synthetic primer
gttgtttctagattatcagtagcaggtgccgtccacctccgccatgacaac

SEQ ID NO: 558 - DNA, 36 bp, Artificial Sequence
  Description of Artificial Synthetic primer
gttgttagatctcaagaagatgaaaggattgttctt

SEQ ID NO: 559 - DNA, 36 bp, Artificial Sequence
  Description of Artificial Synthetic primer
gttgtttctagattagtcaggatagcaggcatctgg

SEQ ID NO: 560 - DNA, 70 bp, Artificial Sequence
  Description of Artificial Synthetic primer
gatcaatccaactctgaagaagcaaagaaagaggaggccaaaaaggaggaagccaagaaatctaacagcg

SEQ ID NO: 561 - DNA, 51 bp, Artificial Sequence
  Description of Artificial Synthetic primer
gttgttgatcagccagttccctcaactccacctaccccatctccctcaact

SEQ ID NO: 562 - DNA, 45 bp, Artificial Sequence
  Description of Artificial Synthetic primer
gttgtttctagattatcagtccacctccgccatgacaacagacac

SEQ ID NO: 563 - DNA, 70 bp, Artificial Sequence
  Description of Artificial Synthetic primer
tcgacgctgttagatttcttggcttcctcctttttggcctcctctttctttgcttcttcagagttggatt

SEQ ID NO: 564 - DNA, 51 bp, Artificial Sequence; identical to SEQ ID NO: 561
  Description of Artificial Synthetic primer

SEQ ID NO: 565 - DNA, 45 bp, Artificial Sequence
  Description of Artificial Synthetic primer
gttgtttctagattatcatttacccgccaagcggtcgatggtctt

SEQ ID NO: 566 - protein, 10 aa, Artificial Sequence
  Description of Artificial Synthetic peptide
PAPELLDGPS

SEQ ID NO: 567 - protein, 10 aa, Artificial Sequence
  Description of Artificial Synthetic peptide
PAPELLDGSS

SEQ ID NO: 568 - DNA, 72 bp, Artificial Sequence
  Description of Artificial Synthetic primer
gttgttgaagacgttcccctgctgccacctgctcttgtccacggtgagcttgctgtagaggtagaaggagcc

SEQ ID NO: 569 - DNA, 72 bp, Artificial Sequence
  Description of Artificial Synthetic primer
gttgttgaagacgttcccctgctgccacctgctcttgtccacggtgagcttgctgtagagggcgaaggagcc

SEQ ID NO: 570 - DNA, 72 bp, Artificial Sequence
  Description of Artificial Synthetic primer
gttgttgaagacgttcccctgctgccacctgctcttgtccacggtgagcttgctggcgaggaagaaggagcc

SEQ ID NO: 571 - DNA, 72 bp, Artificial Sequence
  Description of Artificial Synthetic primer
gttgttgaagacgttcccctgctgccacctgctcttgtccacggtgagcttgctggcgaggtagaaggagcc

SEQ ID NO: 572 - DNA, 72 bp, Artificial Sequence
  Description of Artificial Synthetic primer
gttgttgaagacgttcccctgctgccacctgctcttgtccacggtgagcttgctggcgagggcgaaggagcc

SEQ ID NO: 573 - DNA, 63 bp, Artificial Sequence; identical to SEQ ID NO: 142
  Description of Artificial Synthetic primer

SEQ ID NO: 574 - DNA, 52 bp, Artificial Sequence; identical to SEQ ID NO: 551
  Description of Artificial Synthetic primer

SEQ ID NO: 575 - DNA, 35 bp, Artificial Sequence
  Description of Artificial Synthetic primer
gttgttgatcacgtctgctccagggacttcacccc

SEQ ID NO: 576 - DNA, 49 bp, Artificial Sequence
  Description of Artificial Synthetic primer
gttgtttctagattaacttttaccgggatttacagacaccgctcgctgg

SEQ ID NO: 577 - DNA, 56 bp, Artificial Sequence; identical to SEQ ID NO: 552
  Description of Artificial Synthetic primer

SEQ ID NO: 578 - DNA, 30 bp, Artificial Sequence; identical to SEQ ID NO: 553
  Description of Artificial Synthetic primer

SEQ ID NO: 579 - DNA, 33 bp, Artificial Sequence
  Description of Artificial Synthetic primer
gttgttgtcgacatccagatgactcagtctcca

SEQ ID NO: 580 - DNA, 41 bp, Artificial Sequence
  Description of Artificial Synthetic primer
gtcaagcttgccgccatggtatccacagctcagttccttgg

SEQ ID NO: 581 - DNA, 57 bp, Artificial Sequence
  Description of Artificial Synthetic primer
gccacccgacccaccaccgcccgagccaccgccacctttgatctccagttcggtgcc

SEQ ID NO: 582 - DNA, 60 bp, Artificial Sequence
  Description of Artificial Synthetic primer
tcgggcggtggtgggtcgggtggcggcggatcgtcagcggtccagctgcagcagtctgga

SEQ ID NO: 583 - DNA, 39 bp, Artificial Sequence
  Description of Artificial Synthetic primer
tcagtgctgatcagaagagacggtgactgaggttccttg

SEQ ID NO: 584 - DNA, 32 bp, Artificial Sequence
  Description of Artificial Synthetic primer
gcagcagtctggacctgagtcggaaaagcctg

SEQ ID NO: 585 - DNA, 30 bp, Artificial Sequence
  Description of Artificial Synthetic primer
ctcaggtccagactgctgcagctggaccgc

SEQ ID NO: 586 - DNA, 50 bp, Artificial Sequence
  Description of Artificial Synthetic primer
ggatccacccgctgctgcaaaaacattccctccaatgccacctccgtgac

SEQ ID NO: 587 - DNA, 57 bp, Artificial Sequence
  Description of Artificial Synthetic primer
tcatttaccgggatttacagacaccgctcgctggacggtctgtgaggggctcgctgc

SEQ ID NO: 588 - DNA, 33 bp, Artificial Sequence
  Description of Artificial Synthetic primer
gttgttgatcacgtctgctccagggacttcacc

SEQ ID NO: 589 - DNA, 48 bp, Artificial Sequence
  Description of Artificial Synthetic primer
gttgtttctagattatcatttaccaggatttacagacaccgctcgctg

SEQ ID NO: 590 - DNA, 49 bp, Artificial Sequence
  Description of Artificial Synthetic primer
gttgttttcgaaggatccgctttaccagatttacagacaccgctcgctg

SEQ ID NO: 591 - DNA, 48 bp, Artificial Sequence
  Description of Artificial Synthetic primer
actcacacatccccaccgtccccagcatccaacccgagaggggtgagc

SEQ ID NO: 592 - DNA, 48 bp, Artificial Sequence
  Description of Artificial Synthetic primer
tctgatcaggagcccaaatcttctgacaaaactcacacatccccaccg

SEQ ID NO: 593 - DNA, 48 bp, Artificial Sequence; identical to SEQ ID NO: 589
  Description of Artificial Synthetic primer

SEQ ID NO: 594 - DNA, 33 bp, Artificial Sequence
  Description of Artificial Synthetic primer
atctgttctcctcctactactcctcctccacct

SEQ ID NO: 595 - DNA, 45 bp, Artificial Sequence
  Description of Artificial Synthetic primer
tcagtagcagatgccatctccctctgacatgatgacagacacgct

SEQ ID NO: 596 - DNA, 45 bp, Artificial Sequence
  Description of Artificial Synthetic primer
gttgttgatcacatctgttctcctcctactactcctcctccacct

SEQ ID NO: 597 - DNA, 45 bp, Artificial Sequence
  Description of Artificial Synthetic primer
gttgtttctagattatcaatctccctctgacatgatgacagacac

SEQ ID NO: 598 - DNA, 39 bp, Artificial Sequence
  Description of Artificial Synthetic primer
gttcttcgaaggatccgcatctccctctgacatgatgac

SEQ ID NO: 599 - DNA, 38 bp, Artificial Sequence
  Description of Artificial Synthetic primer
tctatcaggaaccctcagctctaccccttgaagccctg

SEQ ID NO: 600 - DNA, 48 bp, Artificial Sequence
  Description of Artificial Synthetic primer
gttgtttctagattatcaggatggacggagggaggtgttaccaaggct

SEQ ID NO: 601 - DNA, 42 bp, Artificial Sequence
  Description of Artificial Synthetic primer
gttgttgatcacgttcgacctgtcaacatcactgagcccacc

SEQ ID NO: 602 - DNA, 48 bp, Artificial Sequence; identical to SEQ ID NO: 600
  Description of Artificial Synthetic primer

SEQ ID NO: 603 - DNA, 42 bp, Artificial Sequence
  Description of Artificial Synthetic primer
gttgttttcgaaggatccgcggatggacggagggaggtgtta

SEQ ID NO: 604 - DNA, 45 bp, Artificial Sequence
  Description of Artificial Synthetic primer
gttgttaccggtgcaatgcggactgaagatctcccaaaggctgtg

SEQ ID NO: 605 - DNA, 42 bp, Artificial Sequence
  Description of Artificial Synthetic primer
gttgtttgatcagccaaaccttgagtgatggtgatgttcaca

SEQ ID NO: 606 - DNA, 42 bp, Artificial Sequence
  Description of Artificial Synthetic primer
gttgttaagcttgccgccatggattcacaggcccaggttctt

SEQ ID NO: 607 - DNA, 42 bp, Artificial Sequence
  Description of Artificial Synthetic primer
gttgttgtcgacattgtgatgtcacagtctccatcctcccta

SEQ ID NO: 608 - DNA, 39 bp, Artificial Sequence
  Description of Artificial Synthetic primer
tcagtgctgatcatgaggagacggtgactgaggttcctt

SEQ ID NO: 609 - DNA, 60 bp, Artificial Sequence
  Description of Artificial Synthetic primer
tcgggcggtggtgggtcgggtggcggcggatcgtcacaggtgcagttgaaggagtcagga

SEQ ID NO: 610 - DNA, 63 bp, Artificial Sequence
  Description of Artificial Synthetic primer
acccgacccaccaccgcccgagccaccgccaccttttatttccagcttggtgccacctccgaa

SEQ ID NO: 611 - DNA, 42 bp, Artificial Sequence
  Description of Artificial Synthetic primer
gttgttaagcttgccgccatgaggttctctgctcagcttctg

SEQ ID NO: 612 - DNA, 44 bp, Artificial Sequence
  Description of Artificial Synthetic primer
gttgttgtcgacatttgtgatgacgcaggctgcattctccaatt

SEQ ID NO: 613 - DNA, 40 bp, Artificial Sequence
  Description of Artificial Synthetic primer
tcagtgctgatcagaggaggacggtgactgaggttccttg

SEQ ID NO: 614 - DNA, 59 bp, Artificial Sequence
  Description of Artificial Synthetic primer
cgggcggtggtgggtcgggtggcggcggatcgtcacaggtgcagctgaagcagtcagga

SEQ ID NO: 615 - DNA, 59 bp, Artificial Sequence
  Description of Artificial Synthetic primer
cccgacccaccaccgcccgagccaccgccacccttcagctccagcttggtgccagcacc

SEQ ID NO: 616 - DNA, 48 bp, Artificial Sequence
  Description of Artificial Synthetic primer
gttgttaagcttgccgccatgaagttgcctgttaggctgttggtgctg

SEQ ID NO: 617 - DNA, 66 bp, Artificial Sequence
  Description of Artificial Synthetic primer
agagctcccacctcctccagatccaccaccgcccgagccaccgccatctttgatttccagcttggt

SEQ ID NO: 618 - DNA, 51 bp, Artificial Sequence
  Description of Artificial Synthetic primer
tttcagagtaatctgagagctcccacctcctccagatccaccaccgcccga

SEQ ID NO: 619 - DNA, 39 bp, Artificial Sequence
  Description of Artificial Synthetic primer
tcagtgctgatcatgcagagagacagtgaccagagtccc

SEQ ID NO: 620 - DNA, 60 bp, Artificial Sequence
  Description of Artificial Synthetic primer
ggcggatctctgcagatccagttggtgcagtctggacctgagtcgaagaagcctggagag

SEQ ID NO: 621 - DNA, 19 bp, Artificial Sequence
  Description of Artificial Synthetic primer
ggacagtgggagtggcacc

SEQ ID NO: 622 - DNA, 44 bp, Artificial Sequence
  Description of Artificial Synthetic primer
caggttcagctgcagcagtctggggctgagtcggtgaggcctgg

SEQ ID NO: 623 - DNA, 27 bp, Artificial Sequence
  Description of Artificial Synthetic primer
ggaggattcgtctgcagtcagagtggc

SEQ ID NO: 624 - DNA, 61 bp, Artificial Sequence
  Description of Artificial Synthetic primer
ggagatggttttctcgatgggggctgggagggctttgttggagaccgagcacttgtactcc

SEQ ID NO: 625 - DNA, 19 bp, Artificial Sequence
  Description of Artificial Synthetic primer
ggacagtgggagtggcacc

SEQ ID NO: 626 - DNA, 61 bp, Artificial Sequence
  Description of Artificial Synthetic primer
ccgtctctgatcaggagcccaaatcttctgacaaaactcacacatccccaccgtccccagc

SEQ ID NO: 627 - DNA, 65 bp, Artificial Sequence
  Description of Artificial Synthetic primer
tccccaccgtccccagcacctgaactcctggggggatcgtcagtcttcctcttccccccaaaacc

SEQ ID NO: 628 - DNA, 17 bp, Artificial Sequence
  Description of Artificial Synthetic primer
caggaaacagctatgac

SEQ ID NO: 629 - DNA, 61 bp, Artificial Sequence
  Description of Artificial Synthetic primer
ccgtctctgatcaggaccccaaatcttgtgacaaaactcacacatccccaccgtccccagc

SEQ ID NO: 630 - DNA, 65 bp, Artificial Sequence; identical to SEQ ID NO: 627
  Description of Artificial Synthetic primer

SEQ ID NO: 631 - DNA, 61 bp, Artificial Sequence; identical to SEQ ID NO: 626
  Description of Artificial Synthetic primer

SEQ ID NO: 632 - DNA, 74 bp, Artificial Sequence
  Description of Artificial Synthetic primer
gcagggtgtacacctgtggttctcggggctgccctttggctttggagatggttttctcgatggaggctgggagg

SEQ ID NO: 633 - DNA, 61 bp, Artificial Sequence; identical to SEQ ID NO: 629
  Description of Artificial Synthetic primer

SEQ ID NO: 634 - DNA, 74 bp, Artificial Sequence; identical to SEQ ID NO: 632
  Description of Artificial Synthetic primer

SEQ ID NO: 635 - DNA, 59 bp, Artificial Sequence
  Description of Artificial Synthetic primer
ttcctcttccccccaaaacccaaggacaccctcatgatctcccggaaccctgaggtcac

SEQ ID NO: 636 - DNA, 19 bp, Artificial Sequence
  Description of Artificial Synthetic primer
ggacagtgggagtggcacc

SEQ ID NO: 637 - DNA, 61 bp, Artificial Sequence; identical to SEQ ID NO: 626
  Description of Artificial Synthetic primer

SEQ ID NO: 638 - DNA, 65 bp, Artificial Sequence; identical to SEQ ID NO: 627
  Description of Artificial Synthetic primer

SEQ ID NO: 639-640 - skipped (2 entries)

SEQ ID NO: 641 - DNA, 63 bp, Artificial Sequence
  Description of Artificial Synthetic primer
ttcctcttccccccaaaacccaaggacaccctcatgatctcccagaacgctaaggtcacatgc

SEQ ID NO: 642 - DNA, 61 bp, Artificial Sequence; identical to SEQ ID NO: 626
  Description of Artificial Synthetic primer

SEQ ID NO: 643 - skipped

SEQ ID NO: 644 - DNA, 61 bp, Artificial Sequence; identical to SEQ ID NO: 626
  Description of Artificial Synthetic primer

SEQ ID NO: 645 - DNA, 22 bp, Artificial Sequence
  Description of Artificial Synthetic primer
gctcccgcggctgtgtcttggc

SEQ ID NO: 646 - skipped

SEQ ID NO: 647 - DNA, 59 bp, Artificial Sequence
  Description of Artificial Synthetic primer
ggaggtgggcagggtgtacacctgtggttctcggggctgccctttgggtttggagatgg

SEQ ID NO: 648 - DNA, 91 bp, Artificial Sequence; identical to SEQ ID NO: 99
  Description of Artificial Synthetic primer

SEQ ID NO: 649 - DNA, 33 bp, Artificial Sequence
  Description of Artificial Synthetic primer
gttgtttctagattatcatttacccggagacag

SEQ ID NO: 650 - DNA, 45 bp, Artificial Sequence
  Description of Artificial Synthetic primer
gttgttaagcttgccgccatggagacagacacactcctgctatgg

SEQ ID NO: 651 - DNA, 60 bp, Artificial Sequence
  Description of Artificial Synthetic primer
gccacccgacccaccaccgcccgagccaccgccacctttgatttccagcttggtgcctcc

SEQ ID NO: 652 - DNA, 33 bp, Artificial Sequence
  Description of Artificial Synthetic primer
gttgttgtcgacattgtgctgacccaatctcca

SEQ ID NO: 653 - DNA, 59 bp, Artificial Sequence
  Description of Artificial Synthetic primer
tcgggcggtggtgggtcgggtggcggcggatcgtcacaggttcagctgcagcagtctgg

SEQ ID NO: 654 - DNA, 39 bp, Artificial Sequence
  Description of Artificial Synthetic primer
tcagtgctgatcagaggagacggtgactgaggttccttg

SEQ ID NO: 655 - DNA, 48 bp, Artificial Sequence
  Description of Artificial Synthetic primer
gttgttaagcttgccgccatggattttcaagtgcagattttcagcttc

SEQ ID NO: 656 - DNA, 63 bp, Artificial Sequence
  Description of Artificial Synthetic primer
gccacccgacccaccaccgcccgagccaccgccaccagagagctctttcagctccagcttggt

SEQ ID NO: 657 - DNA, 46 bp, Artificial Sequence
  Description of Artificial Synthetic primer
gttgttgtcgacattgttctctcccagtctccagcaatcctgtctg

SEQ ID NO: 658 - DNA, 57 bp, Artificial Sequence
  Description of Artificial Synthetic primer
tcgggcggtggtgggtcgggtggcggcggatctctgcagatccagttggtgcagtct

SEQ ID NO: 659 - DNA, 39 bp, Artificial Sequence
  Description of Artificial Synthetic primer
tcagtgctgatcagaggagactgtgagagtggtgccttg

SEQ ID NO: 660 - DNA, 90 bp, Artificial Sequence
  Description of Artificial Synthetic primer
gttgtagatcaggagcccaaatcttctgacaaaactcacacatctccaccgtccccagcacctgaactcctgggggaccgtcagtcttcc

SEQ ID NO: 661 - DNA, 59 bp, Artificial Sequence
  Description of Artificial Synthetic primer
gttgttttcgaaggatccgctttacccgggagcagggagaggctcttctgcgtgtagtg

SEQ ID NO: 662 - DNA, 36 bp, Artificial Sequence
  Description of Artificial Synthetic primer
gttgttgatcagccagttccctcaactccacctacc

SEQ ID NO: 663 - DNA, 44 bp, Artificial Sequence
  Description of Artificial Synthetic primer
gttgttttcgaaggatccgcgtccacctccgccatgacaacaga

SEQ ID NO: 664 - DNA, 33 bp, Artificial Sequence; identical to SEQ ID NO: 588
  Description of Artificial Synthetic primer

SEQ ID NO: 665 - DNA, 49 bp, Artificial Sequence; identical to SEQ ID NO: 590
  Description of Artificial Synthetic primer

SEQ ID NO: 666 - DNA, 45 bp, Artificial Sequence; identical to SEQ ID NO: 199
  Description of Artificial Synthetic primer

SEQ ID NO: 667 - DNA, 45 bp, Artificial Sequence
  Description of Artificial Synthetic primer
gttgttatcgatctcgagtcagggtgtttctgaggaagacacagt

SEQ ID NO: 668 - DNA, 60 bp, Artificial Sequence
  Description of Artificial Synthetic primer
gttgtagatctggagcccagagggcccacaatcaagccctctcctccaagcaaaagccca

SEQ ID NO: 669 - DNA, 42 bp, Artificial Sequence
  Description of Artificial Synthetic primer
gttgttttcgaaggatccgctttacccggagtccgggagaag

SEQ ID NO: 670 - DNA, 49 bp, Artificial Sequence
  Description of Artificial Synthetic primer
gttgttggatccttcgaacatggagaacaacaaaacctcagtggattca

SEQ ID NO: 671 - DNA, 45 bp, Artificial Sequence; identical to SEQ ID NO: 204
  Description of Artificial Synthetic primer

SEQ ID NO: 672 - DNA, 46 bp, Artificial Sequence; identical to SEQ ID NO: 205
  Description of Artificial Synthetic primer

SEQ ID NO: 673 - DNA, 48 bp, Artificial Sequence; identical to SEQ ID NO: 206
  Description of Artificial Synthetic primer

SEQ ID NO: 674 - DNA, 45 bp, Artificial Sequence; identical to SEQ ID NO: 207
  Description of Artificial Synthetic primer

SEQ ID NO: 675 - DNA, 48 bp, Artificial Sequence; identical to SEQ ID NO: 208
  Description of Artificial Synthetic primer

SEQ ID NO: 676 - DNA, 45 bp, Artificial Sequence; identical to SEQ ID NO: 209
  Description of Artificial Synthetic primer

SEQ ID NO: 677 - DNA, 48 bp, Artificial Sequence; identical to SEQ ID NO: 210
  Description of Artificial Synthetic primer

SEQ ID NO: 678 - DNA, 44 bp, Artificial Sequence
  Description of Artificial Synthetic primer
gttgttgtcgacattgttctgactcagtctccagccaccctgtc

SEQ ID NO: 679 - DNA, 35 bp, Artificial Sequence
  Description of Artificial Synthetic primer
gttgttgatcagagacagtgaccagtgtcccttgg

SEQ ID NO: 680-681 - skipped (2 entries)

SEQ ID NO: 682 - protein, 15 aa, Artificial Sequence
  Description of Artificial Synthetic peptide linker
DGGGSGGGGSGGGGS

SEQ ID NO: 683 - protein, 24 aa, Artificial Sequence
  Description of Artificial Synthetic hinge construct
PASPSPTPPTSPSPTPPTSPVPQD

SEQ ID NO: 684 - protein, 234 aa, Homo sapiens
DQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 685 - protein, 248 aa, Lama glama
  MOD_RES (189): Variable amino acid
  MOD_RES (208): Variable amino acid
  MOD_RES (211): Variable amino acid
DQEPKTPKPQPQPQPQPNPTTESKCPKCPAPELLGGPSVFIFPPKPKDVLSISGRPEVTCVVVDVGQEDPEVSFNWYIDGTAEVRANTRPKEEQFNSTYRVVSVLPIQHQDWLTGKEFKCKVNNKALPAPIEKTISKAKGQTREPQVYTLAPHREELAKDTVSVTCLVKGFYPPDINVEWQRNGQPESXGTYATTPPQLDNDGTYFLXSKXSVGKNTWQQGETFTCVVMHEALHNHYTQKSITQSSGK

SEQ ID NO: 686 - protein, 231 aa, Lama glama; identical to SEQ ID NO: 4

SEQ ID NO: 687 - protein, 234 aa, Lama glama
AHHSEDPTSKCPKCPGPELLGGPTVFIFPPKAKDVLSITRKPEVTCLWWTWVKKTLRSSSSWSVDDTEVHTAETKPKEEQFNSTYRVVSVLPIQHQDWLTGKEFKCKVNNKALPAPIERTISKAKGQTREPQVYTLAPHREELAKDTVSVTCLVKGFFPADINVEWQRNGQPESEGTYANTPPQLDNDGTYFLYSKLSVGKNTWQQGEVFTCVVMHEALHNHSTQKSITQSSGK

SEQ ID NO: 688 - DNA, 1518 bp, Artificial Sequence
  Description of Artificial Sequence: Synthetic nucleotide sequence
  CDS (13)..(1509)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatcaggagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaacaatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgatctaga

SEQ ID NO: 689 - protein, 499 aa, Artificial Sequence
  Description of Artificial Sequence: Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 690 - DNA, 1470 bp, Artificial Sequence
  Description of Artificial Synthetic nucleotide sequence
  CDS (13)..(1458)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccaagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 691 - protein, 482 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 692 - DNA, 1290 bp, Artificial Sequence
  Description of Artificial Synthetic nucleotide sequence
  CDS (13)..(1278)
aagcttgccgccatggattttcaagtgcagattttcagcttcctgctaatcagtgcttcagtcataattgccagaggacaaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccccatccaacctggcttctggagtccctgctcgcttcagtggcagtgggtctgggacctcttactctctcacaatcagcagagtggaggctgaagatgctgccacttattactgccagcagtggagttttaacccacccacgttcggtgctgggaccaagctggagctgaaaggtggcggtggctcgggcggtggtggatctggaggaggtgggagctctcaggcttatctacagcagtctggggctgagctggtgaggcctggggcctcagtgaagatgtcctgcaaggcttctggctacacatttaccagttacaatatgcactgggtaaagcagacacctagacagggcctggaatggattggagctatttatccaggaaatggtgatacttcctacaatcagaagttcaagggcaaggccacactgactgtagacaaatcctccagcacagcctacatgcagctcagcagcctgacatctgaagactctgcggtctatttctgtgcaagagtggtgtactatagtaactcttactggtacttcgatgtctggggcacagggaccacggtcaccgtctctgatccagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactcgagtgataatctaga

SEQ ID NO: 693 - protein, 422 aa, Artificial Sequence
  Description of Artificial Synthetic amino acid sequence
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKGGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 694 - protein, 159 aa, Homo sapiens
KCCVECPPCPAPPVAGPSVFLFPPKPKDTLMISRTPEVTCVVVDVSHEDPEVQFNWYVDGMEVHNAKTKPREEQFNSTFFRVVSVLTVVHQDWLNGKEYKCKVSNKGLPAPIEKTISKTKGQPREPQVYTLPPSREEMTKNQVSLTCLVKGFYPSDIAV

SEQ ID NO: 695 - protein, 160 aa, Homo sapiens
DTPPPCPRCPAPELLGGPSVFLFPPKPKDTLMISRTPEVTCVVVDVSHEDPEVQFKWYVDGVEVHNAKTKPWEEQYNSTFFRVVSVLTVLHQDWLNGKEYKCKVSNKALPAPIEKTISKTKGQPREPQVYTLPPSREEMTKNQVSLTCLVKGFYPSDIAM

SEQ ID NO: 696 - protein, 160 aa, Homo sapiens
  MOD_RES (96): Variable amino acid
  MOD_RES (106): Variable amino acid
  MOD_RES (119): Variable amino acid
  MOD_RES (121): Variable amino acid
KYGPPCPSCPAPEFLGGPSVFLFPPKPKDTLMISRTPEVTCVVVDVSQEDPEVQFNWYVDGVEVHNAKTKPREEQFNSTYYRVVSVLTVLHQDWLXGKEYKCKVSXKGLPSSIEKTISXAXGQPREPQVYTLPPSQEEMTKNQVSLTCLVKGFYPSDIAV

SEQ ID NO: 697 - protein, 160 aa, Homo sapiens
DKTHTCPPCPAPELLGGPSVFLFPPKPKDTLMISRTPEVTCVVVDVSHEDPEVKFNWYVDGVEVHNAKTKPREEQYNSTYYRVVSVLTVLHQDWLNGKEYKCKVSNKALPAPIEKTISKAKGQPREPQVYTLPPSRDELTKNQVSLTCLVKGFYPSDIAV

SEQ ID NO: 698 - protein, 160 aa, Homo sapiens
PTCPTCHKCPVPELLGGPSVFIFPPKPKDILLISQNAKVTCVVVDVSEEEPDVQFSWFVNNVEVHTAQTQPREEQYNSTFFRVVSALPIQHQDWMSGKEFKCKVNNKALPSPIEKTISKPKGLVRKPQVYVMGPPTEQLTEQTVSLTCLTSGFLPNDIGV

SEQ ID NO: 699 - skipped

The invention claimed is:

1. A fusion protein that binds CD20 comprising an amino acid sequence as set forth in:
SEQ ID NO:135 (2H7 scFv (CSS-S)H WCH2 WCH3), wherein proline at position 283 is substituted with serine;
SEQ ID NO:137 (2H7 scFv (SCS-S)H WCH2 WCH3), wherein proline at position 283 is substituted with serine;
SEQ ID NO:166 (2H7 scFv (CSC-S)H WCH2 WCH3), wherein proline at position 283 is substituted with serine;
SEQ ID NO:372 (2H7 scFv VHL11S (CSS-S)H WCH2 WCH3);
SEQ ID NO:246 (2H7 scFv VH L11S (CSC-S)H WCH2 WCH3);
SEQ ID NO:370 (2H7 scFv VH L11S (SSS-S)H WCH2 WCH3);
SEQ ID NO:268 (2H7 scFv VH L11S (CSS-S)H K322S CH2 WCH3); or
SEQ ID NO:276 (2H7 scFv VH L11S (CSS-S)H P331S CH2 WCH3).

2. A fusion protein that binds CD20 consisting essentially of an amino acid sequence as set forth in SEQ ID NO:135 (2H7 scFv (CSS-S)H WCH2 WCH3) wherein proline at position 283 is substituted with serine, SEQ ID NO:166 (2H7 scFv (CSC-S)H WCH2 WCH3) wherein proline at position 283 is substituted with serine, SEQ ID NO:372 (2H7 scFv VHL11S (CSS-S)H WCH2 WCH3), or SEQ ID NO:246 (2H7 scFv VH L11S (CSC-S)H WCH2 WCH3).

3. A fusion protein comprising from amino-terminus to carboxy-terminus: (i) an scFv binding domain polypeptide that binds CD20, wherein the scFv comprises amino acids 23-265 of SEQ ID NO:246; (ii) an immunoglobulin hinge polypeptide consisting of amino acids 269-283 as set forth in SEQ ID NO:246; and (iii) an amino-terminally truncated immunoglobulin heavy chain constant region polypeptide consisting of amino acids 284-500 as set forth in SEQ ID NO:246.

4. A pharmaceutical composition comprising a fusion protein according to claim 1 and a physiologically acceptable carrier.

5. A pharmaceutical composition comprising a fusion protein according to claim 2 and a physiologically acceptable carrier.

6. A pharmaceutical composition comprising a fusion protein according to claim 3 and a physiologically acceptable carrier.

* * * * *

UNITED STATES PATENT AND TRADEMARK OFFICE
CERTIFICATE OF CORRECTION

PATENT NO. : 7,754,209 B2  
APPLICATION NO. : 10/566409  
DATED : July 13, 2010  
INVENTOR(S) : Jeffrey A. Ledbetter et al.

Page 1 of 1

It is certified that error appears in the above-identified patent and that said Letters Patent is hereby corrected as shown below:

Title Page, Delete,

Item (63) and (60)
"(63) Continuation of application No. 10/627,556, filed on Jul. 26, 2003, which is a continuation-in-part of application No. 10/053,530, filed on Jan. 17, 2002, now abandoned.
(60) Provisional application No. 60/367,358, filed on Jan. 17, 2001, now abandoned."

and Replace with,
 --(63) Continuation-in-part of application No. 10/627,556, filed on Jul. 26, 2003.--.

Signed and Sealed this

Seventeenth Day of May, 2011

David J. Kappos
*Director of the United States Patent and Trademark Office*